(12) United States Patent
Bothmer et al.

(10) Patent No.: US 11,667,911 B2
(45) Date of Patent: Jun. 6, 2023

(54) USE OF EXONUCLEASES TO IMPROVE CRISPR/CAS-MEDIATED GENOME EDITING

(71) Applicant: Editas Medicine, Inc., Cambridge, MA (US)

(72) Inventors: Anne Helen Bothmer, Boston, MA (US); Cecilia Cotta-Ramusino, Cambridge, MA (US); Luis A. Barrera, Somerville, MA (US)

(73) Assignee: Editas Medicine, Inc., Cambridge, MA (US)

( * ) Notice: Subject to any disclaimer, the term of this patent is extended or adjusted under 35 U.S.C. 154(b) by 609 days.

(21) Appl. No.: 15/761,968

(22) PCT Filed: Sep. 23, 2016

(86) PCT No.: PCT/US2016/053562
§ 371 (c)(1),
(2) Date: Mar. 21, 2018

(87) PCT Pub. No.: WO2017/053879
PCT Pub. Date: Mar. 30, 2017

(65) Prior Publication Data
US 2018/0273932 A1 Sep. 27, 2018

Related U.S. Application Data

(60) Provisional application No. 62/335,395, filed on May 12, 2016, provisional application No. 62/232,147, filed on Sep. 24, 2015.

(51) Int. Cl.
| | | |
|---|---|---|
| C12N 15/10 | (2006.01) | |
| A61K 9/51 | (2006.01) | |
| A61K 31/7105 | (2006.01) | |
| A61K 38/46 | (2006.01) | |
| C12N 9/22 | (2006.01) | |
| C12N 15/11 | (2006.01) | |

(52) U.S. Cl.
CPC .......... *C12N 15/102* (2013.01); *A61K 9/5123* (2013.01); *A61K 31/7105* (2013.01); *A61K 38/465* (2013.01); *C12N 9/22* (2013.01); *C12N 15/11* (2013.01); *C12Y 301/11002* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| | | | |
|---|---|---|---|
| 6,867,028 B2 * | 3/2005 | Janulaitis | C12N 15/10 |
| | | | 435/194 |
| 8,546,553 B2 | 10/2013 | Terns et al. | |
| 8,697,359 B1 | 4/2014 | Zhang | |
| 8,771,945 B1 | 7/2014 | Zhang | |
| 8,795,965 B2 | 8/2014 | Zhang | |
| 8,865,406 B2 | 10/2014 | Zhang et al. | |
| 8,871,445 B2 | 10/2014 | Cong et al. | |
| 8,889,356 B2 | 11/2014 | Zhang | |
| 8,889,418 B2 | 11/2014 | Zhang et al. | |
| 8,895,308 B1 | 11/2014 | Zhang et al. | |
| 8,906,616 B2 | 12/2014 | Zhang et al. | |
| 8,932,814 B2 | 1/2015 | Cong et al. | |
| 8,945,839 B2 | 2/2015 | Zhang | |
| 8,993,233 B2 | 3/2015 | Zhang et al. | |
| 8,999,641 B2 | 4/2015 | Zhang et al. | |
| 9,023,649 B2 | 5/2015 | Mali et al. | |
| 9,074,199 B1 | 7/2015 | Chavez et al. | |
| 9,228,208 B2 | 1/2016 | Frendewey et al. | |
| 9,234,213 B2 | 1/2016 | Wu | |

(Continued)

FOREIGN PATENT DOCUMENTS

| | | | | |
|---|---|---|---|---|
| WO | WO 99/61064 A1 * | 12/1999 | | A61K 48/00 |
| WO | WO-2007/025097 A2 | 3/2007 | | |

(Continued)

OTHER PUBLICATIONS

US 10,077,445 B2, 09/2018, Doudna et al. (withdrawn)
Ran et al. 2013. Cell 154, pp. 1380-1389 (Year: 2013).*
Shen et al. 2014, Nature Methods, 11:4, p. 399 (Year: 2014).*
Chari et al., 2015 Nature Methods, 12:9, p. 823 (Year: 2015).*
Aubert et al., In vitro Inactivation of Latent HSV by Targeted Mutagenesis Using an HSV-specific Homing Endonuclease. Mol Ther Nucleic Acids. Feb. 4, 2014,3:e146. 12 pages.
Bennardo et al., ATM limits incorrect end utilization during non-homologous end joining of multiple chromosome breaks. PLoS Genet. Nov. 4, 2010;6(11):e1001194. 11 pages.

(Continued)

*Primary Examiner* — Nancy J Leith
(74) *Attorney, Agent, or Firm* — McCarter & English, LLP; Maria Laccotripe Zacharakis; Marcie B. Clarke

(57) ABSTRACT

The present disclosure is directed to methods of producing a modified nucleic acid comprising a precise deletion in a target nucleic acid in a cell comprising generating, within the cell, a first single strand break on a first strand of the target nucleic acid and a second single strand break on a second strand of the target nucleic acid, thereby forming a double strand break in the target nucleic acid having a first 3' overhang and a second 3' overhang; processing the first 3' overhang and the second 3' overhang with an exonuclease molecule, thereby deleting the segment of the target nucleic acid that was located between the first single strand break and the second single strand break, and forming a processed double strand break; and allowing the processed double strand break to be repaired by at least one DNA repair pathway, thereby producing the modified nucleic acid comprising the precise deletion in the target nucleic acid in the cell. Gene editing systems, vectors, polynucleotides, and methods of treatment are also disclosed herein.

25 Claims, 24 Drawing Sheets
Specification includes a Sequence Listing.

(56) References Cited

U.S. PATENT DOCUMENTS

| | | |
|---|---|---|
| 9,260,723 B2 | 2/2016 | Mali et al. |
| 9,260,752 B1 | 2/2016 | May et al. |
| 9,267,135 B2 | 2/2016 | Church et al. |
| 9,322,037 B2 | 4/2016 | Liu et al. |
| 9,388,430 B2 | 7/2016 | Liu et al. |
| 9,404,098 B2 | 8/2016 | Terns et al. |
| 9,410,198 B2 | 8/2016 | May et al. |
| 9,422,553 B2 | 8/2016 | Terns et al. |
| 9,476,065 B2 | 10/2016 | Horwitz et al. |
| 9,493,844 B2 | 11/2016 | Sastry-Dent et al. |
| 9,512,444 B2 | 12/2016 | Chen et al. |
| 9,512,446 B1 | 12/2016 | Joung et al. |
| 9,528,124 B2 | 12/2016 | Fahrenkrug et al. |
| 9,546,384 B2 | 1/2017 | Frendewey et al. |
| 9,567,603 B2 | 2/2017 | Joung et al. |
| 9,567,604 B2 | 2/2017 | Joung et al. |
| 9,587,252 B2 | 3/2017 | Church et al. |
| 9,637,739 B2 | 5/2017 | Univerrsity |
| 9,663,782 B2 | 5/2017 | Yu et al. |
| 9,688,971 B2 | 6/2017 | Doudna et al. |
| 9,725,714 B2 | 8/2017 | May et al. |
| 9,738,908 B2 | 8/2017 | Wu |
| 9,752,132 B2 | 9/2017 | Joung et al. |
| 9,790,490 B2 | 10/2017 | Zhang et al. |
| 9,803,194 B2 | 10/2017 | May et al. |
| 9,809,814 B1 | 11/2017 | May et al. |
| 9,822,370 B2 | 11/2017 | Musunuru et al. |
| 9,822,372 B2 | 11/2017 | Zhang et al. |
| 9,840,713 B2 | 12/2017 | Zhang |
| 9,873,894 B2 | 1/2018 | Conway et al. |
| 9,879,269 B2 | 1/2018 | Barrangou et al. |
| 9,885,026 B2 | 2/2018 | Brouns et al. |
| 9,902,974 B2 | 2/2018 | Conway et al. |
| 9,909,122 B2 | 3/2018 | May et al. |
| 9,926,545 B2 | 3/2018 | Joung et al. |
| 9,926,546 B2 | 3/2018 | Joung et al. |
| 9,944,912 B2 | 4/2018 | Joung et al. |
| 9,963,689 B2 | 5/2018 | Doudna et al. |
| 9,970,001 B2 | 5/2018 | Miller |
| 9,970,024 B2 | 5/2018 | Church et al. |
| 9,970,028 B2 | 5/2018 | Cost et al. |
| 10,041,092 B2 | 8/2018 | Horwitz et al. |
| 10,066,233 B2 | 9/2018 | Barrangou et al. |
| 10,077,453 B2 | 9/2018 | Liu et al. |
| 10,093,910 B2 | 10/2018 | Joung et al. |
| 10,100,291 B2 | 10/2018 | Chavez et al. |
| 10,113,167 B2 | 10/2018 | Doudna et al. |
| 10,113,179 B2 | 10/2018 | Begemann et al. |
| 10,113,207 B2 | 10/2018 | Wang |
| 10,119,133 B2 | 11/2018 | Joung et al. |
| 10,125,361 B2 | 11/2018 | May et al. |
| 2010/0076057 A1 | 3/2010 | Sontheimer et al. |
| 2010/0093617 A1 | 4/2010 | Barrangou et al. |
| 2013/0011828 A1 | 1/2013 | Barrangou et al. |
| 2014/0068797 A1 | 3/2014 | Doudna et al. |
| 2014/0093941 A1 | 4/2014 | Terns et al. |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0189896 A1 | 7/2014 | Zhang et al. |
| 2014/0199767 A1 | 7/2014 | Barrangou et al. |
| 2014/0242664 A1 | 8/2014 | Zhang et al. |
| 2014/0242699 A1 | 8/2014 | Zhang |
| 2014/0256046 A1 | 9/2014 | Zhang et al. |
| 2014/0273037 A1 | 9/2014 | Wu |
| 2014/0273226 A1 | 9/2014 | Wu |
| 2014/0273230 A1 | 9/2014 | Chen et al. |
| 2014/0273233 A1 | 9/2014 | Chen et al. |
| 2014/0287938 A1 | 9/2014 | Zhang et al. |
| 2014/0294773 A1 | 10/2014 | Brouns et al. |
| 2014/0302563 A1 | 10/2014 | Doudna et al. |
| 2014/0310830 A1 | 10/2014 | Zhang et al. |
| 2014/0315985 A1 | 10/2014 | May et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0356956 A1 | 12/2014 | Church et al. |
| 2014/0357523 A1 | 12/2014 | Zeiner et al. |
| 2014/0357530 A1 | 12/2014 | Zhang et al. |
| 2014/0377868 A1 | 12/2014 | Joung et al. |
| 2015/0020223 A1 | 1/2015 | Zhang et al. |
| 2015/0024499 A1 | 1/2015 | Brouns et al. |
| 2015/0024500 A1 | 1/2015 | Yu et al. |
| 2015/0031132 A1 | 1/2015 | Church et al. |
| 2015/0031133 A1 | 1/2015 | Church et al. |
| 2015/0031134 A1 | 1/2015 | Zhang et al. |
| 2015/0044772 A1 | 2/2015 | Zhao |
| 2015/0045546 A1 | 2/2015 | Siksnys et al. |
| 2015/0050699 A1 | 2/2015 | Siksnys et al. |
| 2015/0056705 A1 | 2/2015 | Conway et al. |
| 2015/0071889 A1 | 3/2015 | Musunuru et al. |
| 2015/0071898 A1 | 3/2015 | Liu et al. |
| 2015/0071899 A1 | 3/2015 | Liu et al. |
| 2015/0079680 A1 | 3/2015 | Bradley et al. |
| 2015/0079681 A1 | 3/2015 | Zhang |
| 2015/0128300 A1 | 5/2015 | Warming et al. |
| 2015/0140664 A1 | 5/2015 | Byrne et al. |
| 2015/0159174 A1 | 6/2015 | Frendewey et al. |
| 2015/0159175 A1 | 6/2015 | Frendewey et al. |
| 2015/0176013 A1 | 6/2015 | Musunuru et al. |
| 2015/0184139 A1 | 7/2015 | Zhang et al. |
| 2015/0184199 A1 | 7/2015 | Horwitz et al. |
| 2015/0203872 A1 | 7/2015 | Zhang |
| 2015/0232833 A1 | 8/2015 | Mali et al. |
| 2015/0232882 A1 | 8/2015 | Zhang et al. |
| 2015/0232883 A1* | 8/2015 | Dahlman ............. C12N 9/22 435/462 |
| 2015/0240261 A1 | 8/2015 | Siksnys et al. |
| 2015/0240263 A1 | 8/2015 | Holmes et al. |
| 2015/0247150 A1 | 9/2015 | Zhang et al. |
| 2015/0259684 A1 | 9/2015 | Church et al. |
| 2015/0259704 A1 | 9/2015 | Church et al. |
| 2015/0284727 A1 | 10/2015 | Kim et al. |
| 2015/0291961 A1 | 10/2015 | Siksnys et al. |
| 2015/0291965 A1 | 10/2015 | Zhang et al. |
| 2015/0291966 A1 | 10/2015 | Zhang et al. |
| 2015/0322457 A1 | 11/2015 | Kim et al. |
| 2015/0344912 A1 | 12/2015 | Kim et al. |
| 2015/0353905 A1 | 12/2015 | Weiss et al. |
| 2015/0353917 A1 | 12/2015 | Miller |
| 2015/0356239 A1 | 12/2015 | Zhang et al. |
| 2015/0376645 A1 | 12/2015 | Zechiedrich et al. |
| 2016/0002670 A1 | 1/2016 | Church et al. |
| 2016/0010076 A1 | 1/2016 | Joung et al. |
| 2016/0010154 A1 | 1/2016 | Laganiere et al. |
| 2016/0017366 A1 | 1/2016 | Chen et al. |
| 2016/0024523 A1 | 1/2016 | Joung et al. |
| 2016/0024524 A1 | 1/2016 | Joung et al. |
| 2016/0024529 A1 | 1/2016 | Carstens |
| 2016/0029604 A1 | 2/2016 | Fahrenkrug et al. |
| 2016/0032274 A1 | 2/2016 | Church et al. |
| 2016/0032292 A1 | 2/2016 | Storici et al. |
| 2016/0040155 A1 | 2/2016 | Maizels et al. |
| 2016/0046949 A1 | 2/2016 | May et al. |
| 2016/0046961 A1 | 2/2016 | Jinek et al. |
| 2016/0046962 A1 | 2/2016 | May et al. |
| 2016/0046963 A1 | 2/2016 | May et al. |
| 2016/0046978 A1 | 2/2016 | May et al. |
| 2016/0060653 A1 | 3/2016 | Doudna et al. |
| 2016/0060654 A1 | 3/2016 | Doudna et al. |
| 2016/0060657 A1 | 3/2016 | Frendewey et al. |
| 2016/0068864 A1 | 3/2016 | Doudna et al. |
| 2016/0068887 A1 | 3/2016 | May et al. |
| 2016/0076020 A1 | 3/2016 | May et al. |
| 2016/0090607 A1 | 3/2016 | Conway et al. |
| 2016/0102324 A1 | 4/2016 | Duchateau et al. |
| 2016/0108470 A1 | 4/2016 | May et al. |
| 2016/0115488 A1 | 4/2016 | Zhang et al. |
| 2016/0115489 A1 | 4/2016 | Zhang et al. |
| 2016/0122774 A1 | 5/2016 | Duchateau et al. |
| 2016/0130608 A1 | 5/2016 | Doudna et al. |
| 2016/0130609 A1 | 5/2016 | Doudna et al. |
| 2016/0138008 A1 | 5/2016 | Doudna et al. |

(56) References Cited

U.S. PATENT DOCUMENTS

| | | |
|---|---|---|
| 2016/0138046 A1 | 5/2016 | Wu |
| 2016/0145644 A1 | 5/2016 | Cost et al. |
| 2016/0145646 A1 | 5/2016 | Frendewey et al. |
| 2016/0153003 A1 | 6/2016 | Joung et al. |
| 2016/0153004 A1 | 6/2016 | Zhang et al. |
| 2016/0153006 A1 | 6/2016 | Zhang et al. |
| 2016/0160210 A1 | 6/2016 | Mali et al. |
| 2016/0160291 A1 | 6/2016 | Scully et al. |
| 2016/0168592 A1 | 6/2016 | Church et al. |
| 2016/0175462 A1 | 6/2016 | Zhang et al. |
| 2016/0177340 A1 | 6/2016 | Bradley et al. |
| 2016/0184362 A1 | 6/2016 | Duchateau et al. |
| 2016/0186152 A1 | 6/2016 | Brouns et al. |
| 2016/0186213 A1 | 6/2016 | Zhang et al. |
| 2016/0186214 A1 | 6/2016 | Brouns et al. |
| 2016/0201089 A1 | 7/2016 | Gersbach et al. |
| 2016/0207983 A1 | 7/2016 | Bradley et al. |
| 2016/0208243 A1 | 7/2016 | Zhang et al. |
| 2016/0215276 A1 | 7/2016 | Liu et al. |
| 2016/0222416 A1 | 8/2016 | Church et al. |
| 2016/0237455 A1 | 8/2016 | Glucksmann et al. |
| 2016/0237456 A1 | 8/2016 | Church et al. |
| 2016/0251640 A1 | 9/2016 | May et al. |
| 2016/0257948 A1 | 9/2016 | Bradley et al. |
| 2016/0257974 A1 | 9/2016 | Bradley et al. |
| 2016/0264995 A1 | 9/2016 | Yamamoto et al. |
| 2016/0272965 A1 | 9/2016 | Zhang et al. |
| 2016/0281072 A1 | 9/2016 | Zhang |
| 2016/0281111 A1 | 9/2016 | Cotta-Ramusino et al. |
| 2016/0298097 A1 | 10/2016 | Chavez et al. |
| 2016/0298125 A1 | 10/2016 | Chen et al. |
| 2016/0298132 A1 | 10/2016 | Chen et al. |
| 2016/0298133 A1 | 10/2016 | Chen et al. |
| 2016/0298134 A1 | 10/2016 | Chen et al. |
| 2016/0298135 A1 | 10/2016 | Chen et al. |
| 2016/0298136 A1 | 10/2016 | Chen et al. |
| 2016/0298137 A1 | 10/2016 | Chen et al. |
| 2016/0298138 A1 | 10/2016 | Chen et al. |
| 2016/0304855 A1 | 10/2016 | Stark et al. |
| 2016/0304907 A1 | 10/2016 | Mali et al. |
| 2016/0312198 A1 | 10/2016 | Joung et al. |
| 2016/0312199 A1 | 10/2016 | Joung et al. |
| 2016/0312280 A1 | 10/2016 | May et al. |
| 2016/0319260 A1 | 11/2016 | Joung et al. |
| 2016/0319261 A1 | 11/2016 | Joung et al. |
| 2016/0319281 A1 | 11/2016 | Tsai et al. |
| 2016/0319349 A1 | 11/2016 | May et al. |
| 2016/0340662 A1 | 11/2016 | Zhang et al. |
| 2016/0355796 A1 | 12/2016 | Davidson et al. |
| 2016/0355797 A1 | 12/2016 | Konermann et al. |
| 2016/0355816 A1 | 12/2016 | Terns et al. |
| 2016/0369258 A1 | 12/2016 | Maizels et al. |
| 2016/0376610 A1 | 12/2016 | Davis et al. |
| 2017/0002380 A1 | 1/2017 | Buerckstuemmer |
| 2017/0009256 A1 | 1/2017 | Buerckstuemmer |
| 2017/0016027 A1 | 1/2017 | Lee et al. |
| 2017/0029805 A1 | 2/2017 | Li et al. |
| 2017/0037416 A1 | 2/2017 | Barrangou et al. |
| 2017/0044569 A9 | 2/2017 | Church et al. |
| 2017/0051276 A1 | 2/2017 | May et al. |
| 2017/0051310 A1 | 2/2017 | Doudna et al. |
| 2017/0051312 A1 | 2/2017 | Jinek et al. |
| 2017/0058271 A1 | 3/2017 | Joung et al. |
| 2017/0058272 A1 | 3/2017 | Carter et al. |
| 2017/0058298 A1 | 3/2017 | Kennedy et al. |
| 2017/0058299 A1 | 3/2017 | Horwitz et al. |
| 2017/0067078 A1 | 3/2017 | Frendewey et al. |
| 2017/0073705 A1 | 3/2017 | Chen et al. |
| 2017/0081650 A1 | 3/2017 | Joung et al. |
| 2017/0107536 A1 | 4/2017 | Zhang et al. |
| 2017/0152508 A1 | 6/2017 | Joung et al. |
| 2017/0152528 A1 | 6/2017 | Zhang |
| 2017/0166875 A1 | 6/2017 | Maizels et al. |
| 2017/0166893 A1 | 6/2017 | Doudna et al. |
| 2017/0166903 A1 | 6/2017 | Zhang et al. |
| 2017/0175140 A1 | 6/2017 | Hummel et al. |
| 2017/0175142 A1 | 6/2017 | Zhang et al. |
| 2017/0175144 A1 | 6/2017 | Zhang et al. |
| 2017/0191078 A1 | 7/2017 | Zhang et al. |
| 2017/0191082 A1 | 7/2017 | Chen et al. |
| 2017/0198269 A1 | 7/2017 | Zhang et al. |
| 2017/0198277 A1 | 7/2017 | Kmiec et al. |
| 2017/0198302 A1 | 7/2017 | Feng et al. |
| 2017/0211142 A1 | 7/2017 | Smargon et al. |
| 2017/0233703 A1 | 8/2017 | Xie et al. |
| 2017/0251647 A1 | 9/2017 | Mashimo et al. |
| 2017/0260547 A1 | 9/2017 | Dombrowski et al. |
| 2017/0268022 A1 | 9/2017 | Liu et al. |
| 2017/0273284 A1 | 9/2017 | Shen |
| 2017/0275611 A1 | 9/2017 | Bradley et al. |
| 2017/0298330 A1 | 10/2017 | Sato et al. |
| 2017/0306306 A1 | 10/2017 | Potter et al. |
| 2017/0306307 A1 | 10/2017 | Zhang et al. |
| 2017/0306335 A1 | 10/2017 | Zhang et al. |
| 2017/0327805 A1 | 11/2017 | Joung et al. |
| 2017/0327806 A1 | 11/2017 | Joung et al. |
| 2017/0327820 A1 | 11/2017 | May et al. |
| 2017/0349915 A1 | 12/2017 | May et al. |
| 2017/0362611 A1 | 12/2017 | Tsai |
| 2018/0002682 A1 | 1/2018 | Sternberg et al. |
| 2018/0016601 A1 | 1/2018 | Qi et al. |
| 2018/0030425 A1 | 2/2018 | Joung et al. |
| 2018/0044700 A1 | 2/2018 | Doudna et al. |
| 2018/0049412 A1 | 2/2018 | Shen |
| 2018/0051298 A1 | 2/2018 | Fahrenkrug et al. |
| 2018/0066242 A1 | 3/2018 | Zhang et al. |
| 2018/0073002 A1 | 3/2018 | Deiters et al. |
| 2018/0073039 A1 | 3/2018 | Durocher et al. |
| 2018/0080051 A1 | 3/2018 | Sheikh et al. |
| 2018/0100148 A1 | 4/2018 | Vakulskas et al. |
| 2018/0105564 A1 | 4/2018 | Davis et al. |
| 2018/0112235 A1 | 4/2018 | Li et al. |
| 2018/0119121 A1 | 5/2018 | Brouns et al. |
| 2018/0119175 A1 | 5/2018 | Conway et al. |
| 2018/0127780 A1 | 5/2018 | Liu et al. |
| 2018/0127785 A1 | 5/2018 | Junge et al. |
| 2018/0127787 A1 | 5/2018 | Gurumurthy et al. |
| 2018/0135073 A1 | 5/2018 | Chen et al. |
| 2018/0142262 A1 | 5/2018 | Webber et al. |
| 2018/0148735 A1 | 5/2018 | Begemann et al. |
| 2018/0155708 A1 | 6/2018 | Church et al. |
| 2018/0155716 A1 | 6/2018 | Zhang et al. |
| 2018/0163188 A1 | 6/2018 | Xie et al. |
| 2018/0163213 A1 | 6/2018 | Aneja et al. |
| 2018/0187176 A1 | 7/2018 | Behlke et al. |
| 2018/0187195 A1 | 7/2018 | Siksnys et al. |
| 2018/0208931 A1 | 7/2018 | Doudna et al. |
| 2018/0216088 A1 | 8/2018 | Joung et al. |
| 2018/0216135 A1 | 8/2018 | Tsai et al. |
| 2018/0230494 A1 | 8/2018 | Joung et al. |
| 2018/0230495 A1 | 8/2018 | Doudna et al. |
| 2018/0230496 A1 | 8/2018 | Doudna et al. |
| 2018/0230497 A1 | 8/2018 | Doudna et al. |
| 2018/0235194 A1 | 8/2018 | Fahrenkrug et al. |
| 2018/0237801 A1 | 8/2018 | Doudna et al. |
| 2018/0245100 A1 | 8/2018 | Doudna et al. |
| 2018/0245101 A1 | 8/2018 | Doudna et al. |
| 2018/0250424 A1 | 9/2018 | Cotta-Ramusino |
| 2018/0251791 A1 | 9/2018 | Doudna et al. |
| 2018/0251793 A1 | 9/2018 | Doudna et al. |
| 2018/0251794 A1 | 9/2018 | Doudna et al. |
| 2018/0251795 A1 | 9/2018 | Charpentier et al. |
| 2018/0265864 A1 | 9/2018 | Li et al. |
| 2018/0273932 A1 | 9/2018 | Bothmer et al. |
| 2018/0273981 A1 | 9/2018 | Doudna et al. |
| 2018/0282713 A1 | 10/2018 | Van Der Oost |
| 2018/0282714 A1 | 10/2018 | Joung et al. |
| 2018/0282764 A1 | 10/2018 | Jinek et al. |
| 2018/0291383 A1 | 10/2018 | Musunuru et al. |
| 2018/0298360 A1 | 10/2018 | Sternberg et al. |
| 2018/0298392 A1 | 10/2018 | Cotta-Ramusino |
| 2018/0298406 A1 | 10/2018 | Doudna et al. |
| 2018/0298407 A1 | 10/2018 | Doudna et al. |
| 2018/0305697 A1 | 10/2018 | Sfeir et al. |

(56) References Cited

U.S. PATENT DOCUMENTS

| | | |
|---|---|---|
| 2018/0305718 A1 | 10/2018 | Nelson et al. |
| 2018/0305719 A1 | 10/2018 | Perez-Pinera et al. |
| 2018/0312824 A1 | 11/2018 | Zhang et al. |
| 2018/0312874 A1 | 11/2018 | Doudna et al. |
| 2018/0312875 A1 | 11/2018 | Doudna et al. |
| 2018/0312876 A1 | 11/2018 | Doudna et al. |
| 2018/0320163 A1 | 11/2018 | Koonin et al. |
| 2018/0320197 A1 | 11/2018 | Gersbach et al. |
| 2018/0320201 A1 | 11/2018 | Vakulskas et al. |
| 2018/0327761 A1 | 11/2018 | Duchateau et al. |

FOREIGN PATENT DOCUMENTS

| | | |
|---|---|---|
| WO | WO-2010/011961 A2 | 1/2010 |
| WO | 2013/009525 A1 | 1/2013 |
| WO | WO-2013/098244 A1 | 7/2013 |
| WO | WO-2013/141680 A1 | 9/2013 |
| WO | WO-2013/142578 A1 | 9/2013 |
| WO | WO-2013/176772 A1 | 11/2013 |
| WO | WO-2013/188522 A2 | 12/2013 |
| WO | WO-2014/018423 A2 | 1/2014 |
| WO | WO-2014/065596 A1 | 5/2014 |
| WO | WO-2014/089290 A1 | 6/2014 |
| WO | WO-2014/093479 A1 | 6/2014 |
| WO | WO-2014/093595 A1 | 6/2014 |
| WO | WO-2014/093622 A2 | 6/2014 |
| WO | WO-2014/093635 A1 | 6/2014 |
| WO | WO-2014/093655 A2 | 6/2014 |
| WO | WO-2014/093661 A2 | 6/2014 |
| WO | WO-2014/093694 A1 | 6/2014 |
| WO | WO-2014/093701 A1 | 6/2014 |
| WO | WO-2014/093709 A1 | 6/2014 |
| WO | WO-2014/093712 A1 | 6/2014 |
| WO | WO-2014/093718 A1 | 6/2014 |
| WO | WO-2014/099744 A1 | 6/2014 |
| WO | WO-2014/099750 A2 | 6/2014 |
| WO | WO-2014/113493 A1 | 7/2014 |
| WO | WO-2014/127287 A1 | 8/2014 |
| WO | WO-2014/143381 A1 | 9/2014 |
| WO | WO-2014/144288 A1 | 9/2014 |
| WO | WO-2014/144592 A2 | 9/2014 |
| WO | WO-2014/144761 A2 | 9/2014 |
| WO | WO-2014/145599 A2 | 9/2014 |
| WO | WO-2014/150624 A1 | 9/2014 |
| WO | WO-2014/152432 A2 | 9/2014 |
| WO | WO-2014/165825 A2 | 10/2014 |
| WO | WO-2014/172458 A1 | 10/2014 |
| WO | WO-2014/186585 A2 | 11/2014 |
| WO | 2014/191518 A1 | 12/2014 |
| WO | 2014/199358 A1 | 12/2014 |
| WO | WO-2014/191521 A2 | 12/2014 |
| WO | WO-2014/197568 A2 | 12/2014 |
| WO | WO-2014/197748 A2 | 12/2014 |
| WO | WO-2014/204578 A1 | 12/2014 |
| WO | WO-2014/204724 A1 | 12/2014 |
| WO | WO-2014/204725 A1 | 12/2014 |
| WO | WO-2014/204727 A1 | 12/2014 |
| WO | WO-2014/204728 A1 | 12/2014 |
| WO | WO-2014/204729 A1 | 12/2014 |
| WO | WO-2015/006290 A1 | 1/2015 |
| WO | WO-2015/010114 A1 | 1/2015 |
| WO | WO-2015/013583 A2 | 1/2015 |
| WO | WO-2015/021426 A1 | 2/2015 |
| WO | WO-2015/035162 A2 | 3/2015 |
| WO | WO-2015/040402 A1 | 3/2015 |
| WO | WO-2015/048577 A2 | 4/2015 |
| WO | WO-2015/077290 A2 | 5/2015 |
| WO | WO-2015/077318 A1 | 5/2015 |
| WO | 2015/086795 A1 | 6/2015 |
| WO | WO-2015/079056 A1 | 6/2015 |
| WO | WO-2015/088643 A1 | 6/2015 |
| WO | WO-2015/089351 A1 | 6/2015 |
| WO | WO-2015/089354 A1 | 6/2015 |
| WO | WO-2015/089427 A1 | 6/2015 |
| WO | WO-2015/089486 A2 | 6/2015 |
| WO | WO-2015/095804 A1 | 6/2015 |
| WO | WO-2015/127439 A1 | 8/2015 |
| WO | WO-2015/138620 A1 | 9/2015 |
| WO | WO-2015/160683 A1 | 10/2015 |
| WO | WO-2015/168125 A1 | 11/2015 |
| WO | WO-2015/188056 A1 | 12/2015 |
| WO | WO-2015/188065 A1 | 12/2015 |
| WO | 2016/028682 A1 | 2/2016 |
| WO | WO-2016/022363 A2 | 2/2016 |
| WO | WO-2016/025759 A1 | 2/2016 |
| WO | WO-2016/036754 A1 | 3/2016 |
| WO | WO-2016/054326 A1 | 4/2016 |
| WO | WO-2016/057821 A2 | 4/2016 |
| WO | WO-2016/057961 A1 | 4/2016 |
| WO | WO-2016/065364 A1 | 4/2016 |
| WO | 2016/073990 A2 | 5/2016 |
| WO | WO-2016/081923 A2 | 5/2016 |
| WO | WO-2016/090385 A1 | 6/2016 |
| WO | WO-2016/100819 A1 | 6/2016 |
| WO | WO-2016/106236 A1 | 6/2016 |
| WO | WO-2016/106244 A1 | 6/2016 |
| WO | WO-2016/112242 A1 | 7/2016 |
| WO | WO-2016/114972 A1 | 7/2016 |
| WO | WO-2016/115326 A1 | 7/2016 |
| WO | WO-2016/138574 A1 | 9/2016 |
| WO | WO-2016/141224 A1 | 9/2016 |
| WO | WO-2016/142719 A1 | 9/2016 |
| WO | WO-2016/154579 A2 | 9/2016 |
| WO | WO-2016/161207 A1 | 10/2016 |
| WO | WO-2016/164797 A1 | 10/2016 |
| WO | WO-2016/166340 A1 | 10/2016 |
| WO | WO-2016/167300 A1 | 10/2016 |
| WO | WO-2016/183448 A1 | 11/2016 |
| WO | WO-2016/195598 A1 | 12/2016 |
| WO | WO-2016/196655 A1 | 12/2016 |
| WO | WO-2016/196887 A1 | 12/2016 |
| WO | WO-2016/205613 A1 | 12/2016 |
| WO | WO-2016/205711 A1 | 12/2016 |
| WO | WO-2016/205749 A1 | 12/2016 |
| WO | WO-2016/205759 A1 | 12/2016 |
| WO | WO-2016/210271 A1 | 12/2016 |
| WO | WO-2017/011519 A1 | 1/2017 |
| WO | WO-2017/015015 A1 | 1/2017 |
| WO | WO-2017/015101 A1 | 1/2017 |
| WO | WO-2017/031483 A1 | 2/2017 |
| WO | WO-2017/040348 A1 | 3/2017 |
| WO | WO-2017/040511 A1 | 3/2017 |
| WO | WO-2017/040709 A1 | 3/2017 |
| WO | WO-2017/048969 A1 | 3/2017 |
| WO | WO-2017/053729 A1 | 3/2017 |
| WO | WO-2017/053879 A1 | 3/2017 |
| WO | WO-2017/062754 A1 | 4/2017 |
| WO | WO-2017/064546 A1 | 4/2017 |
| WO | WO-2017/066588 A2 | 4/2017 |
| WO | WO-2017/070633 A2 | 4/2017 |
| WO | WO-2017/074962 A1 | 5/2017 |
| WO | WO-2017/096041 A1 | 6/2017 |
| WO | WO-2017/099494 A1 | 6/2017 |
| WO | WO-2017/123609 A1 | 7/2017 |
| WO | WO-2017/127807 A1 | 7/2017 |
| WO | WO-2017/129811 A1 | 8/2017 |
| WO | WO-2017/136335 A1 | 8/2017 |
| WO | WO-2017/142923 A1 | 8/2017 |
| WO | WO-2017/147056 A1 | 8/2017 |
| WO | WO-2017/160752 A1 | 9/2017 |
| WO | WO-2017/161068 A1 | 9/2017 |
| WO | WO-2017/165655 A1 | 9/2017 |
| WO | WO-2017/165826 A1 | 9/2017 |
| WO | WO-2017/172775 A1 | 10/2017 |
| WO | WO-2017/180694 A1 | 10/2017 |
| WO | WO-2017/180711 A1 | 10/2017 |
| WO | WO-2017/181107 A2 | 10/2017 |
| WO | WO-2017/184768 A1 | 10/2017 |
| WO | WO-2017/186550 A1 | 11/2017 |
| WO | WO-2017/186718 A1 | 11/2017 |
| WO | WO-2017/189308 A1 | 11/2017 |
| WO | WO-2017/189336 A1 | 11/2017 |
| WO | WO-2017/197238 A1 | 11/2017 |
| WO | WO-2017/201311 A2 | 11/2017 |

(56) References Cited

FOREIGN PATENT DOCUMENTS

| | | |
|---|---|---|
| WO | WO-2017/205650 A1 | 11/2017 |
| WO | WO-2017/207589 A1 | 12/2017 |
| WO | WO-2017/212264 A1 | 12/2017 |
| WO | WO-2017/215648 A1 | 12/2017 |
| WO | WO-2017/216771 A2 | 12/2017 |
| WO | WO-2017/219027 A1 | 12/2017 |
| WO | WO-2017/219033 A1 | 12/2017 |
| WO | WO-2017/220527 A1 | 12/2017 |
| WO | WO-2017/222773 A1 | 12/2017 |
| WO | WO-2018/013840 A1 | 1/2018 |
| WO | WO-2018/013932 A1 | 1/2018 |
| WO | WO-2018/015936 A2 | 1/2018 |
| WO | WO-2018/022634 A1 | 2/2018 |
| WO | WO-2018/025206 A1 | 2/2018 |
| WO | WO-2018/030208 A1 | 2/2018 |
| WO | WO-2018/030457 A1 | 2/2018 |
| WO | WO-2018/033110 A1 | 2/2018 |
| WO | WO-2018/035387 A1 | 2/2018 |
| WO | WO-2018/035388 A1 | 2/2018 |
| WO | WO-2018/035423 A1 | 2/2018 |
| WO | WO-2018/049073 A1 | 3/2018 |
| WO | WO-2018/049077 A1 | 3/2018 |
| WO | WO-2018/049079 A1 | 3/2018 |
| WO | WO-2018/049168 A1 | 3/2018 |
| WO | WO-2018/052247 A1 | 3/2018 |
| WO | WO-2018/053053 A1 | 3/2018 |
| WO | WO-2018/064352 A1 | 4/2018 |
| WO | WO-2018/064371 A1 | 4/2018 |
| WO | WO-2018/068053 A2 | 4/2018 |
| WO | WO-2018/069474 A1 | 4/2018 |
| WO | WO-2018/071663 A1 | 4/2018 |
| WO | WO-2018/071868 A1 | 4/2018 |
| WO | WO-2018/071892 A1 | 4/2018 |
| WO | WO-2018/074979 A1 | 4/2018 |
| WO | WO-2018/081470 A1 | 5/2018 |
| WO | WO-2018/081476 A2 | 5/2018 |
| WO | WO-2018/089437 A1 | 5/2018 |
| WO | WO-2018/089664 A1 | 5/2018 |
| WO | WO-2018/096356 A1 | 5/2018 |
| WO | WO-2018/097257 A1 | 5/2018 |
| WO | WO-2018/098383 A1 | 5/2018 |
| WO | WO-2018/108272 A1 | 6/2018 |
| WO | WO-2018/108338 A1 | 6/2018 |
| WO | WO-2018/108339 A1 | 6/2018 |
| WO | WO-2018/109101 A1 | 6/2018 |
| WO | WO-2018/112451 A1 | 6/2018 |
| WO | WO-2018/119060 A1 | 6/2018 |
| WO | WO-2018/138385 A1 | 8/2018 |
| WO | WO-2018/144546 A1 | 8/2018 |
| WO | WO-2018/149888 A1 | 8/2018 |
| WO | WO-2018/152325 A1 | 8/2018 |
| WO | WO-2018/162702 A1 | 9/2018 |
| WO | WO-2018/170015 A1 | 9/2018 |
| WO | WO-2018/172556 A1 | 9/2018 |
| WO | WO-2018/175872 A1 | 9/2018 |
| WO | WO-2018/188571 A1 | 10/2018 |
| WO | WO-2018/191715 A2 | 10/2018 |
| WO | WO-2018/195313 A1 | 10/2018 |
| WO | WO-2018/195418 A1 | 10/2018 |
| WO | WO-2018/195540 A1 | 10/2018 |
| WO | WO-2018/195545 A2 | 10/2018 |
| WO | WO-2018/195555 A1 | 10/2018 |
| WO | WO-2018/197020 A1 | 11/2018 |
| WO | WO-2018/197495 A1 | 11/2018 |
| WO | WO-2018/209712 A1 | 11/2018 |
| WO | WO-2018/213351 A1 | 11/2018 |

OTHER PUBLICATIONS

De Silva et al., DNA binding induces active site conformational change in the human TREX2 3'-exonuclease. Nucleic Acids Res. Apr. 2009;37(7):2411-7.

Liu et al., In Vitro CRISPR/Cas9 System for Efficient Targeted DNA Editing. MBio. Nov. 10, 2015;6(6):e01714-15.

Maciejowski et al., Chromothripsis and Kataegis Induced by Telomere Crisis. Cell. Dec. 17, 2015;163(7):1641-54.

International Search Report and Written Opinion for Application No. PCT/US2016/053562, dated Dec. 20, 2016. 18 pages.

* cited by examiner

Model of DNA end processing at WT Cas9 induced DSBs with and without ectopic Trex2 expression

| gRNA Pair | Predicted Overhang (nts) | Seqs with precise overhang deletions (%) | Seqs with overhang deletions within 5 nts (%) | |
|---|---|---|---|---|
| 8/15 | 47 | 0 | 4.6 | CTRL |
|  |  | 30.3 | 59.1 | TREX2 |
| 8/19 | 37 | 0 | 3.9 | CTRL |
|  |  | 12.1 | 44.0 | TREX2 |
| 8/21 | 61 | 0 | 0 | CTRL |
|  |  | 23.2 | 43.5 | TREX2 |

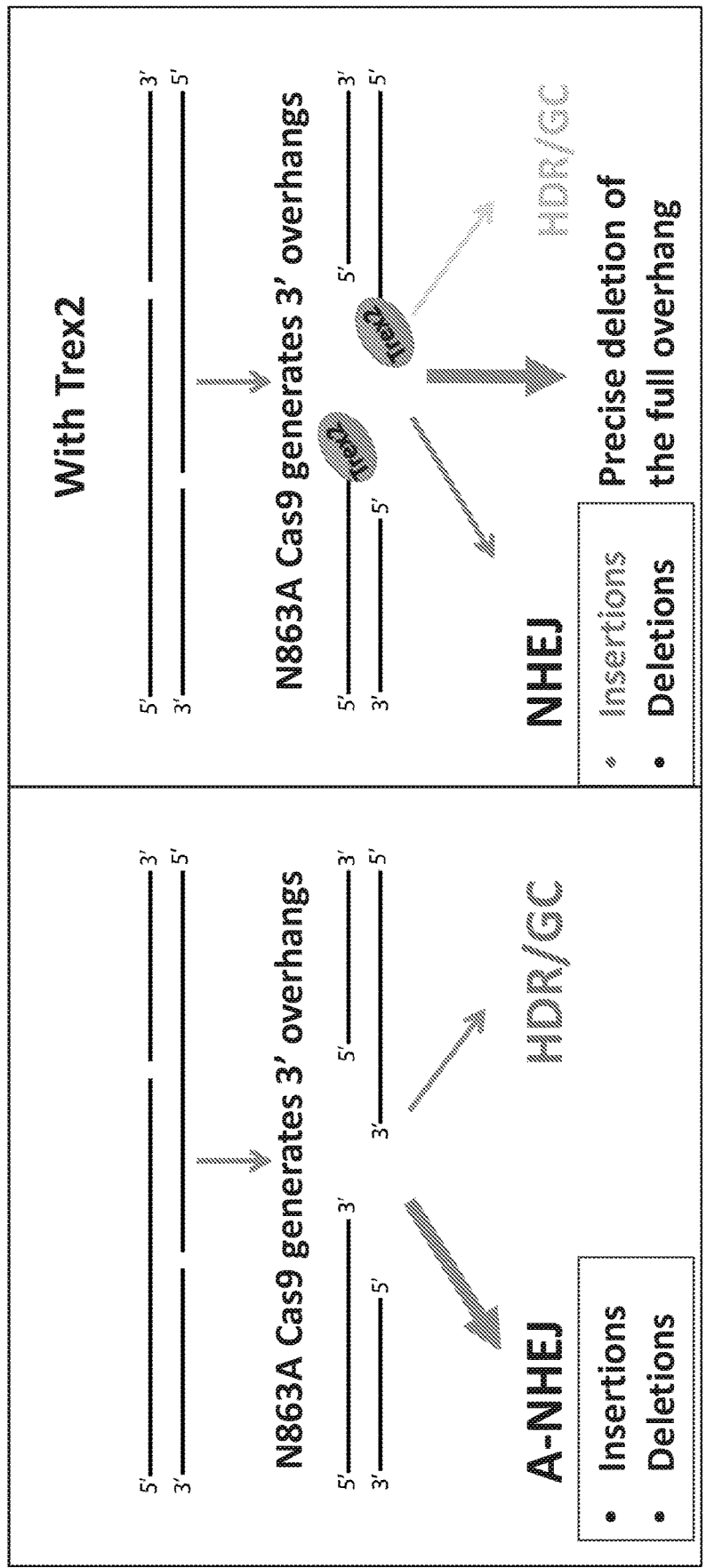
Fig. 10 Model of DNA end processing at N863A Cas9 induced DSBs with and without the ectopic expression of Trex2

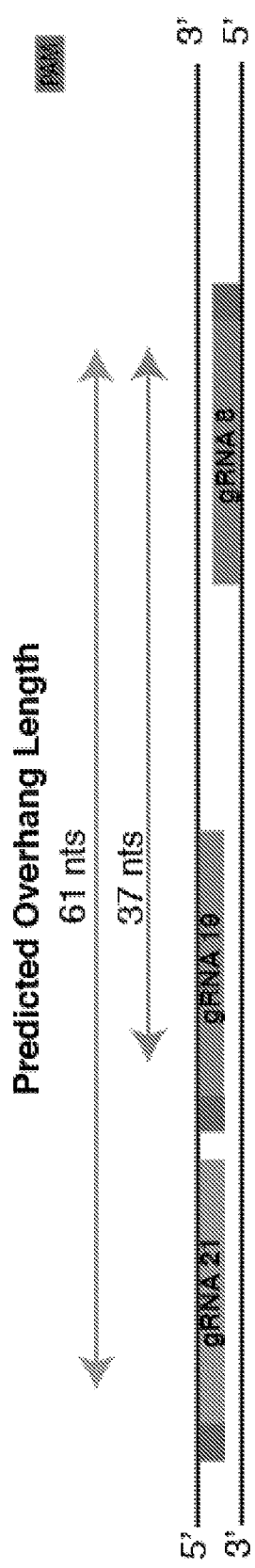
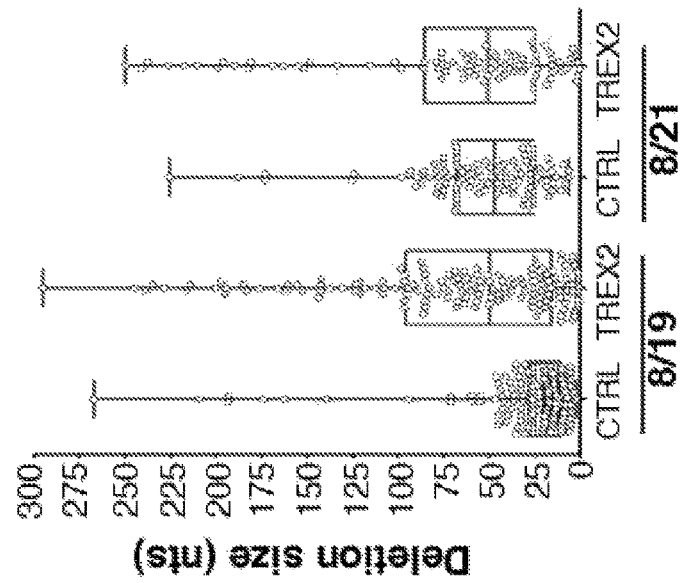
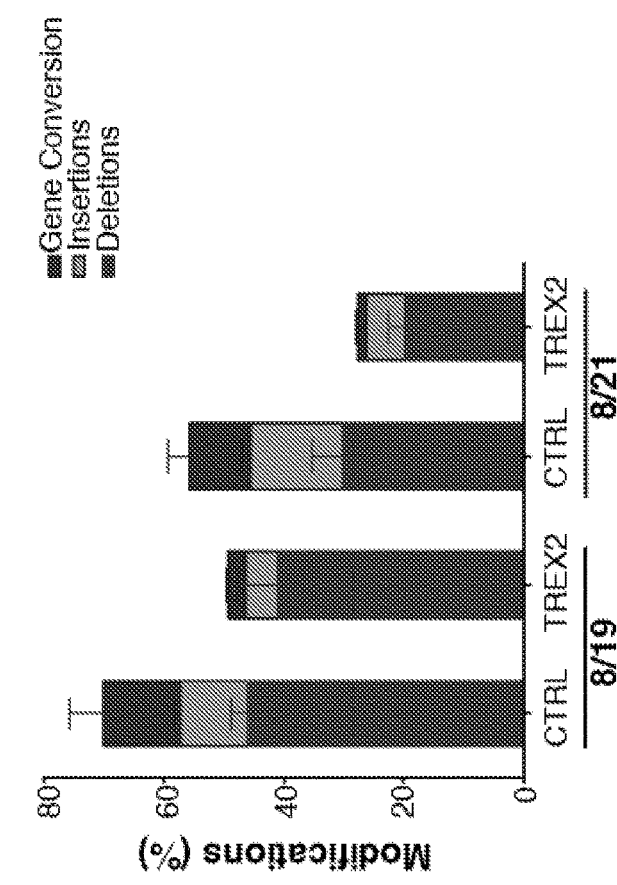

Model of DNA end processing at D10A Cas9 induced DSBs with and without the ectopic expression of Trex2

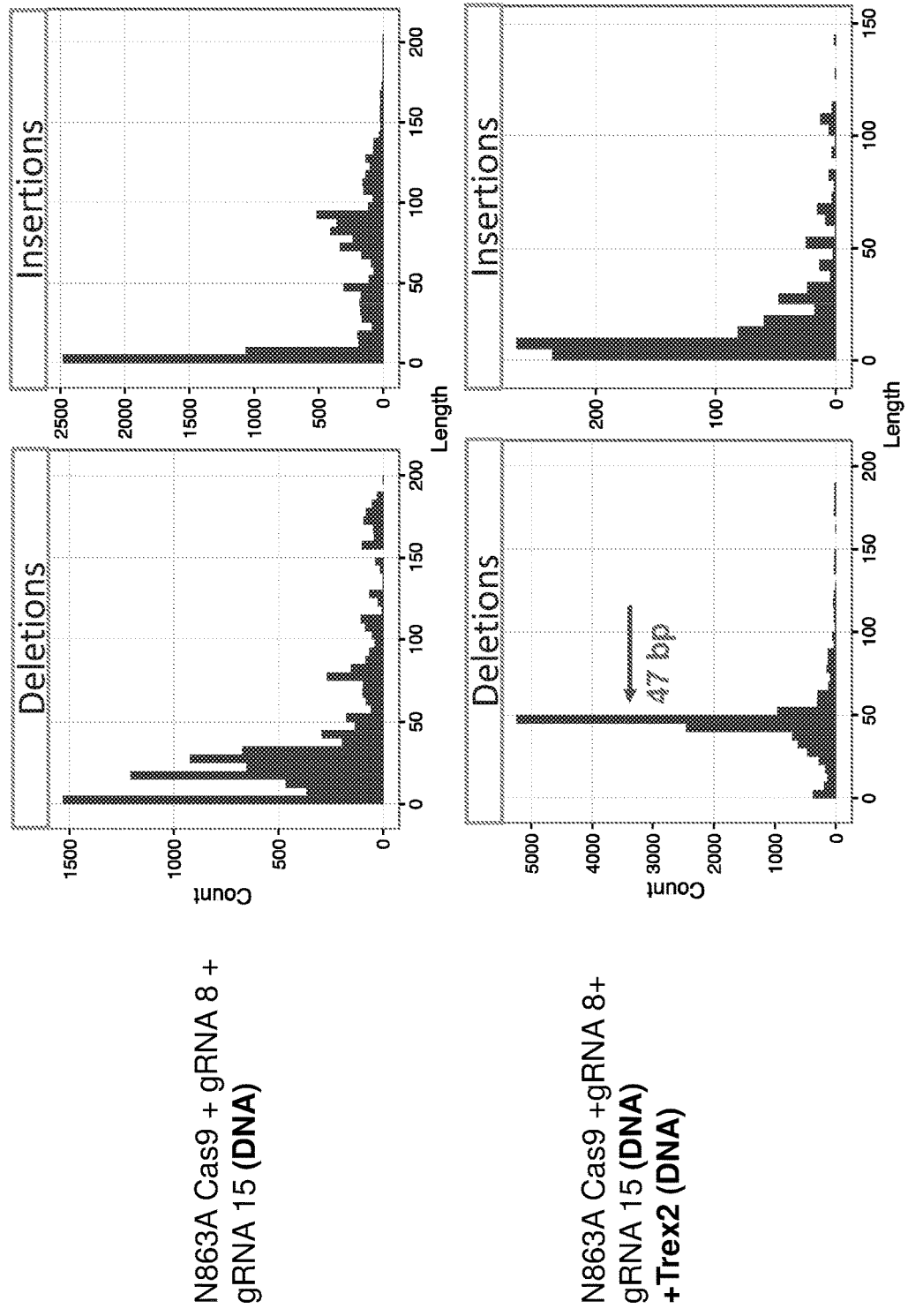

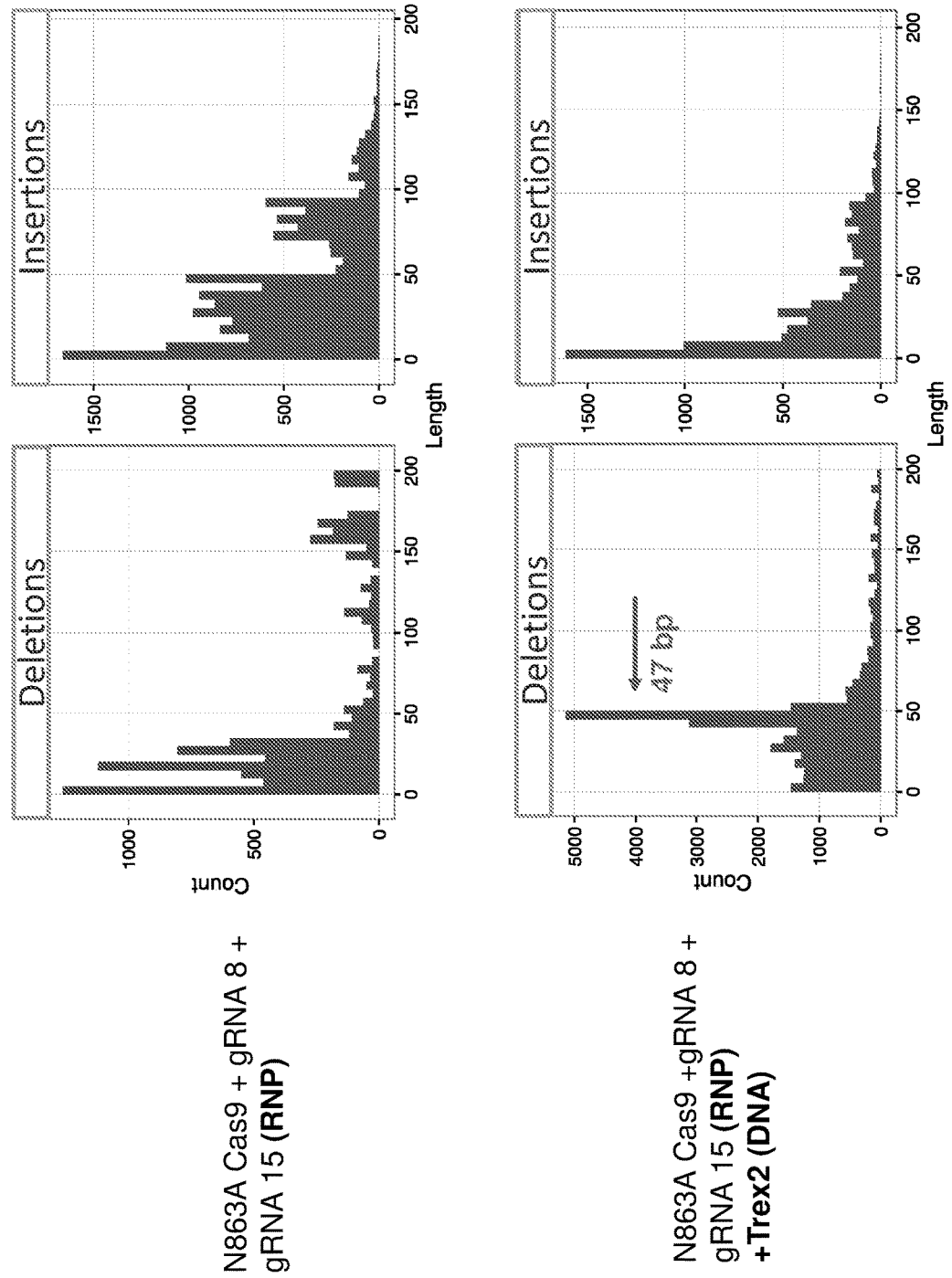

USE OF EXONUCLEASES TO IMPROVE CRISPR/CAS-MEDIATED GENOME EDITING

RELATED APPLICATIONS

This application is a 35 U.S.C. § 371 national stage filing of International Application No. PCT/US2016/053562, filed on Sep. 23, 2016, which in turn claims priority to U.S. Provisional Application No. 62/232,147, filed on Sep. 24, 2015, and U.S. Provisional Application No. 62/335,395, filed May 12, 2016. The entire contents of each of the foregoing applications are expressly incorporated herein by reference.

SEQUENCE LISTING

The instant application contains a Sequence Listing which has been submitted electronically in ASCII format and is hereby incorporated by reference in its entirety. Said ASCII copy, created on Sep. 23, 2016, is named 126454-00620_SeqLst.TXT and is 1,057,000 bytes in size.

BACKGROUND

The CRISPR (Clustered Regularly Interspaced Short Palindromic Repeats)/Cas (CRISPR-associated) system evolved in bacteria and archaea as an adaptive immune system to defend against viral attack. Upon exposure to a virus, short segments of viral DNA are integrated into the CRISPR locus. RNA is transcribed from a portion of the CRISPR locus that includes the viral sequence. That RNA, which contains sequence complimentary to the viral genome, mediates targeting of a Cas9 protein to the sequence in the viral genome. The Cas9 protein cleaves and thereby silences the viral target.

Recently, the CRISPR/Cas system has attracted widespread interest as a tool for genome editing through the generation of site-specific double strand breaks (DSBs). Current CRISPR/Cas systems that generate site-specific DSBs can be used to edit DNA in eukaryotic cells, e.g., by producing deletions, insertions and/or changes in nucleotide sequence, but they may lack precision, and specific edits may occur at low frequency. For instance, where a CRISPR/Cas system is configured to cause deletions by making one or more DSBs, the size of the deletion may vary, and the frequency of desired deletion events may be comparatively low. To date, there have been few, if any, CRISPR/Cas strategies that generate precise deletions with high efficiency.

Without wishing to be bound by any theory, it is thought that the mechanism by which an individual DSB is repaired varies depending on whether or not the DNA ends created by the DSB undergo endo- or exonucleolytic processing (also referred to as "end resection" or "processing"). When no end resection takes place, a DSB is generally repaired by a pathway referred to as classical non-homologous end joining (C-NHEJ). C-NHEJ is considered an "error-prone" pathway inasmuch as it leads in some cases to the formation of small insertions and deletions, though it may also result in perfect repair of DSB without sequence alterations.

In contrast, if end resection does take place, the ends of a DSB may include one or more overhangs (for example, 3' overhangs or 5' overhangs), which can interact with nearby homologous sequences. And again, the mechanism by which the DSB is repaired may vary depending on the extent of processing: when the ends of a DSB undergo relatively limited end resection, the DSB is generally processed by alternative non-homologous end joining (ALT-NHEJ). ALT-NHEJ refers to a class of pathways that includes blunt end-joining (blunt EJ) and microhomology mediated end joining (MMEJ) which tend to result in deletions, as well as synthesis dependent micro homology mediated end joining (SD-MMEJ), which tends to result in insertions. But when end resection is extensive, the resulting overhangs may undergo strand invasion of highly homologous sequences (which can be endogenous sequences, for instance from a sister chromatid, or heterologous sequences from an exogenous template), followed by repair of the DSB by a homology-dependent recombination (HDR) pathway.

SUMMARY

This disclosure concerns systems, methods and compositions that produce targeted, precise deletions in living cells, including human or other mammalian cells at frequencies greater than those previously reported. In various aspects of the disclosure, a given deletion encompasses all (and only) those nucleotides within a target nucleic acid located between first and second single strand breaks formed by paired 3' nickases such as Cas9 N863A, Cas9 H840A or other similar RNA-guided, HNH-mutant nickases, e.g., deletions with lengths of at least 25 nucleotides.

Accordingly in one aspect, provided herein is a gene editing system comprising a first gRNA molecule and a second gRNA molecule; at least one enzymatically active (eaCas9) nickase molecule, or fragment thereof; and a 3' to 5' exonuclease molecule; wherein the first gRNA molecule, the second gRNA molecule, and the at least one eaCas9 nickase molecule are configured to associate with a target nucleic acid and form a DNA double strand break having a 3' overhang.

In another aspect, provided herein is a gene editing system comprising a first gRNA molecule and a second gRNA molecule; at least one nickase molecule; and an exonuclease molecule; wherein the first gRNA molecule and the at least one nickase molecule can associate with a target nucleic acid and generate a first single strand break on a first strand of the target nucleic acid; wherein the second gRNA molecule and the at least one nickase molecule can associate with the target nucleic acid and generate a second single strand break on a second strand of the target nucleic acid, thereby forming a double strand break in the target nucleic acid having a first 3' overhang and a second 3' overhang; wherein the exonuclease molecule can process the first 3' overhang and the second 3' overhang, forming a processed double strand break; and wherein the processed double strand break can be repaired by at least one DNA repair pathway. The at least one nickase molecule can be a nickase molecule of a single species. The at least one nickase molecule can more than one nickase molecule, each of different species. The at least one nickase molecule can be in the form of a pre-formed complex with a gRNA molecule.

The segment of the target nucleic acid can be located between the first single strand break or within 5 base pairs thereof, and the second single strand break or within 5 base pairs thereof, is deleted after repair by the at least one DNA repair pathway.

A portion of the target nucleic acid corresponding to the first 3' overhang, or a fragment of the first 3' overhang, can be deleted after repair by the at least one DNA repair pathway. A portion of the target nucleic acid corresponding to the second 3' overhang, or a fragment of the second 3' overhang, can be deleted after repair by the at least one DNA repair pathway. The portion can be the full length segment of the target nucleic acid that is deleted after repair by the at least one DNA repair pathway. The portion can be a fragment of the target nucleic acid that is deleted after repair by the at least one DNA repair pathway.

The at least one nickase molecule can be at least one eaCas9 nickase molecule, or fragment thereof. The at least one eaCas9 nickase molecule, or fragment thereof, can comprise N-terminal RuvC-like domain cleavage activity but have no HNH-like domain cleavage activity. The at least one eaCas9 nickase molecule, or fragment thereof, can comprise an amino acid mutation at an amino acid position corresponding to amino acid position N863 of *Streptococcus pyogenes* Cas9.

The at least one eaCas9 nickase molecule, or fragment thereof, can be a nucleic acid encoding an eaCas9 polypeptide, or fragment thereof. The at least one eaCas9 nickase molecule, or fragment thereof, can be at least one eaCas9 polypeptide, or fragment thereof.

The first gRNA molecule and a first eaCas9 nickase molecule can be a first pre-formed complex, and the second gRNA molecule and a second eaCas9 nickase molecule are a second pre-formed complex. The first eaCas9 nickase molecule and the second eaCas9 nickase molecule can each be of the same species or of different species.

The exonuclease molecule can be a nucleic acid encoding a Trex2 polypeptide, or fragment thereof. The nucleic acid encoding the Trex2 polypeptide can comprise a nucleic acid sequence that is at least 85% identical to the nucleic acid sequence of SEQ ID NO: 256.

The exonuclease molecule can be a Trex2 polypeptide, or fragment thereof. The Trex2 polypeptide can comprise an amino acid sequence that is at least 85% identical to the amino acid sequence of SEQ ID NO: 255.

The gene editing system can comprise no more than four different species of gRNA molecules. The segment of the target nucleic acid can be at least about 15, 20, 25, 30, 40, 50, 75, or 100 base pairs in length.

In another aspect, provided herein is a polynucleotide encoding the gene editing system described herein. In yet another aspect, provided herein is a vector encoding the gene editing system described herein. In another aspect, provided herein is a lipid particle comprising the gene editing system described herein. In yet another aspect, provided herein is a pharmaceutical composition comprising the gene editing system described herein.

In yet another aspect, provided herein is a composition, comprising a first gRNA molecule and a second gRNA molecule; at least one eaCas9 nickase molecule; and a Trex2 molecule; wherein the first gRNA molecule and the at least one eaCas9 nickase molecule can associate with a target nucleic acid and generate a first single strand break on a first strand of the target nucleic acid; wherein the second gRNA molecule and the at least one eaCas9 nickase molecule can associate with the target nucleic acid and generate a second single strand break on a second strand of the target nucleic acid, thereby forming a double strand break in the target nucleic acid having a first 3' overhang and a second 3' overhang; wherein the Trex2 molecule can process the first 3' overhang and the second 3' overhang thereby forming a processed double strand break; and wherein the processed double strand break can be repaired by at least one DNA repair pathway, thereby deleting a segment of the target nucleic acid that is located between the first single strand break or within 5 base pairs thereof, and the second single strand break or within 5 base pairs thereof.

In yet another aspect, provided herein is a gene editing vector system comprising one or more nucleic acids comprising a first gRNA molecule and a second gRNA molecule; a nickase molecule, or fragment thereof; and a 3' to 5' exonuclease molecule; wherein the first gRNA molecule, the second gRNA molecule, and the at least one eaCas9 nickase molecule are configured to associate with a target nucleic acid and form a DNA double strand break having a 3' overhang.

In another aspect, provided herein is a gene editing vector system comprising one or more nucleic acids comprising a first gRNA molecule and a second gRNA molecule; at least one nickase molecule; and an exonuclease molecule; wherein the first gRNA molecule and the at least one nickase molecule can associate with a target nucleic acid and generate a first single strand break on a first strand of the target nucleic acid; wherein the second gRNA molecule and the at least one nickase molecule can associate with the target nucleic acid and generate a second single strand break on a second strand of the target nucleic acid, thereby forming a double strand break in the target nucleic acid having a first 3' overhang and a second 3' overhang; wherein the exonuclease molecule can process the first 3' overhang and the second 3' overhang, thereby forming a processed double strand break; and wherein the processed double strand break can be repaired by at least one DNA repair pathway, thereby deleting a segment of the target nucleic acid that is located between the first single strand break or within 5 base pairs thereof, and the second single strand break or within 5 base pairs thereof.

In yet another aspect, provided herein is an isolated polynucleotide, encoding a first gRNA molecule and a second gRNA molecule; at least one nickase molecule; and an exonuclease molecule; wherein the first gRNA molecule and the at least one nickase molecule can associate with a target nucleic acid and generate a first single strand break on a first strand of the target nucleic acid; wherein the second gRNA molecule and the at least one nickase molecule can associate with the target nucleic acid and generate a second single strand break on a second strand of the target nucleic acid, thereby forming a double strand break in the target nucleic acid having a first 3' overhang and a second 3' overhang; wherein the exonuclease molecule can process the first 3' overhang and the second 3' overhang, thereby forming a processed double strand break; and wherein the processed double strand break can be repaired by at least one DNA repair pathway, thereby deleting a segment of the target nucleic acid that is located between the first single strand break or within 5 base pairs thereof, and the second single strand break or within 5 base pairs thereof.

In another aspect, provided herein is a composition, comprising at least one polynucleotide encoding a Cas9 nickase molecule, a first gRNA molecule, a second gRNA molecule, and a Trex2 molecule.

The Cas9 nickase molecule can comprise N-terminal RuvC-like domain cleavage activity but have no HNH-like domain cleavage activity.

In another aspect, provided herein is a method of deleting a segment of a target nucleic acid in a cell, the method comprising contacting the cell with a first gRNA molecule, a second gRNA molecule, and at least one enzymatically active Cas9 (eaCas9) nickase molecule; and contacting the cell with a 3' to 5' exonuclease; wherein the first gRNA molecule, the second gRNA molecule, and the at least one eaCas9 nickase molecule are configured to associate with the target nucleic acid and form a DNA double strand break having a first 3' overhang and a second 3' overhang.

In yet another aspect, provided herein is a method of deleting a segment of a target nucleic acid in a cell, the method comprising generating, within the cell, a first single strand break on a first strand of the target nucleic acid and a second single strand break on a second strand of the target nucleic acid, wherein the first single strand break is located at least 25 base pairs away from the second single strand break, thereby forming a double strand break in the target nucleic acid having a first 3' overhang and a second 3' overhang; and processing the first 3' overhang and the second 3' overhang using a 3' to 5' exonuclease molecule, thereby forming a processed double strand break; wherein the processed double strand break is repaired by at least one DNA repair pathway, thereby deleting the segment of the target nucleic acid that is located between the first single strand break or within 5 base pairs thereof, and the second single strand break or within 5 base pairs thereof.

The first gRNA molecule and the at least one eaCas9 nickase molecule can associate with the target nucleic acid and generate the first single strand break, and the second gRNA molecule and the at least one eaCas9 nickase molecule can associate with the target nucleic acid and generate the second single strand break.

The segment of the target nucleic acid is at least about 15, 20, 25, 30, 40, 50, 75, or 100 base pairs in length.

The step of generating the first single strand break and the second single strand break can comprise contacting the cell with a first gRNA molecule, at least one enzymatically active Cas9 (eaCas9) nickase molecule, and a second gRNA molecule.

The target nucleic acid can be a promoter region of a gene, a coding region of a gene, a non-coding region of a gene, an intron of a gene, or an exon of a gene.

The at least one eaCas9 nickase molecule can comprise N-terminal RuvC-like domain cleavage activity but has no HNH-like domain cleavage activity.

The at least one eaCas9 molecule can comprise an amino acid mutation at an amino acid position corresponding to amino acid position N863 of *Streptococcus pyogenes* Cas9.

The first gRNA molecule and the at least one eaCas9 nickase molecule can associate with a first PAM sequence in the target nucleic acid, wherein the first PAM sequence is facing outward, and wherein the second gRNA molecule and the at least one eaCas9 nickase molecule can associate with a second PAM sequence in the target nucleic acid, wherein the second PAM sequence is facing outward.

The 3' to 5' exonuclease can be a Trex2 molecule. The Trex2 molecule can comprise an amino acid sequence that is at least 85% identical to the amino acid sequence of SEQ ID NO: 255. The Trex2 molecule can comprise a nucleic acid sequence that is at least 85% identical to the nucleic acid sequence of SEQ ID NO: 256.

The method can comprise not contacting the cell with a library comprising more than ten species of gRNA molecules.

The cell can be contacted with two species of gRNA molecules.

In some embodiments, the exonuclease molecule does not cause off-target mutagenesis.

The cell can be a mammalian cell. The mammalian cell can be a human cell.

The segment of the target nucleic acid can comprise a frameshift mutation, an exon, a regulatory element, a splice donor, a splice acceptor, or a sequence that forms a secondary structure.

The cell can be a population of cells, wherein at least 20% of the cells in the population of cells comprise a deletion of the segment of the target nucleic acid. The cell can be a population of cells, wherein 20%-40% of cells in the population of cells comprise a deletion of the segment of the target nucleic acid.

The segment of the target nucleic acid can be located between the first single strand break or within 5 base pairs thereof, and the second single strand break or within 5 base pairs thereof.

At least a portion of the segment of the target nucleic acid can correspond to the first 3' overhang, or a fragment of the first 3' overhang.

At least a portion of the segment of the target nucleic acid can correspond to the second 3' overhang, or a fragment of the second 3' overhang.

The segment of the target nucleic acid can have a length of either 5 base pairs more, or 5 base pairs less, than the number of base pairs between the first single strand break and the second single strand break.

In another aspect, provided herein is a cell modified using a method described herein.

In yet another aspect, a pharmaceutical composition comprising the cell modified as described herein is provided.

In another aspect, provided herein is an isolated population of cells modified using a method described herein, wherein the population of cells comprises a distribution of lengths of the segment of the target nucleic acid: (a) having a mean length and/or a median length within 5 base pairs of the number of base pairs between the first single strand break and the second single strand break; and b) having a median absolute deviation that is lower than a corresponding median absolute deviation in the distribution of lengths of the segment of the target nucleic acid in a second isolated population of cells modified by contacting the second population of cells with the first gRNA molecule, the second gRNA molecule, and the at least one enzymatically active Cas9 (eaCas9) nickase molecule, without contacting the second population of cells with the 3' to 5' exonuclease.

In another aspect, provided herein is an isolated population of cells modified using a method described herein, wherein the population of cells comprises a distribution of lengths of the segment of the target nucleic acid having a mean length within 5 base pairs of the number of base pairs between the first single strand break and the second single strand break.

In another aspect, provided herein is an isolated population of cells modified using a method described herein, wherein the population of cells comprises a distribution of lengths of the segment of the target nucleic acid having a median length within 5 base pairs of the number of base pairs between the first single strand break and the second single strand break.

In another aspect, provided herein is an isolated population of cells modified using a method described herein, wherein the population of cells comprises a distribution of lengths of the segment of the target nucleic acid having a median absolute deviation that is lower than a corresponding median absolute deviation in the distribution of lengths of the segment of the target nucleic acid in a second isolated population of cells modified by contacting the second population of cells with the first gRNA molecule, the second gRNA molecule, and the at least one enzymatically active Cas9 (eaCas9) nickase molecule, without contacting the second population of cells with the 3' to 5' exonuclease.

In another aspect, provided herein is an isolated population of cells modified by a method described herein, wherein the population of cells comprises a distribution of lengths of the segment of the target nucleic acid having a median absolute deviation that is lower than a corresponding median absolute deviation in the distribution of lengths of the segment of the target nucleic acid in a second isolated population of cells modified by contacting the second population of cells with the first gRNA molecule, the second gRNA molecule, and the at least one enzymatically active Cas9 (eaCas9) nickase molecule, without contacting the second population of cells with the 3' to 5' exonuclease.

The difference between the mean length and the median length of the distribution of lengths of the segment of the target nucleic acid in the isolated population of cells can be smaller than a corresponding difference between a mean length and a median length of a distribution of lengths observed in the second isolated population of cells.

The difference between the mean length and the median length of the distribution of lengths of the segment of the target nucleic acid in the isolated population of cells can be less than 5 base pairs (e.g., 4, 3, 2, 1, or 0 base pairs).

In one aspect, the present disclosure provides a method of deleting a segment of a target nucleic acid in a cell, the method comprising generating, within the cell, a first single strand break on a first strand of the target nucleic acid and a second single strand break on a second strand of the target nucleic acid, wherein the first single strand break is located at least 25 base pairs away from the second single strand break, thereby forming a double strand break in the target nucleic acid having a first 3' overhang and a second 3' overhang; processing the first 3' overhang and the second 3' overhang with an exonuclease molecule, thereby deleting the segment of the target nucleic acid that was located between the first single strand break and the second single strand break, and forming a processed double strand break; and allowing the processed double strand break to be repaired by at least one DNA repair pathway, wherein the segment of the target nucleic acid between the first and second single strand breaks is deleted from the target nucleic acid in the cell within a precision of 10 base pairs.

In another aspect, the present disclosure provides a method of deleting a segment of a target nucleic acid in a cell, the method comprising generating, within the cell, a first single strand break on a first strand of the target nucleic acid and a second single strand break on a second strand of the target nucleic acid, wherein the first single strand break is located at least 25 base pairs away from the second single strand break, thereby forming a double strand break in the target nucleic acid having a first 3' overhang and a second 3' overhang; processing the first 3' overhang and the second 3' overhang with an exonuclease molecule, thereby deleting the segment of the target nucleic acid that was located between the first single strand break and the second single strand break, and forming a processed double strand break; wherein the processed double strand break can be repaired by at least one DNA repair pathway, and wherein the segment of the target nucleic acid between the first and second single strand breaks is deleted from the target nucleic acid in the cell after the repair by the at least one DNA repair pathway. In some embodiments, the processed double strand break is made under conditions that permit the repair of the double strand break.

In one embodiment, the first single strand break is located at least 14 base pairs away from the second single strand break. In another embodiment, the first single strand break is located at least 20 base pairs away from the second single strand break. In another embodiment, the first single strand break is located 14-25 base pairs away from the second single strand break. In another embodiment, the first single strand break is located at least 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74 or 75 base pairs away from the second single strand break. In one embodiment, the deletion is a precise deletion.

In some embodiments, the segment of the target nucleic acid that is located between the first single strand break and the second single strand break is 25, 37, 47, or 61 base pairs in length. In other embodiments, the segment of the target nucleic acid that is located between the first single strand break and the second single strand break is at least about 10, 15, 20, 30, 40, 50, 75, 100, 150, 200, 250, 300, 400, 500, 750, 1000, 2000, 3000, 4000, 5000, 6000, 7000, 8000, 9000, 10000, 50000, 100000, 250000, 500000, 750000, 1000000, 2000000, 30000000, 4000000, 5000000, 6000000, 7000000, 8000000, 9000000, or 10000000 base pairs in length.

In some embodiments, the target nucleic acid is a promoter region of a gene, a coding region of a gene, a non-coding region of a gene, an intron of a gene, or an exon of a gene.

In some embodiments, the step of generating the first single strand break and the second single strand break comprises contacting the cell with a first gRNA molecule, at least one enzymatically active Cas9 (eaCas9) nickase molecule, and a second gRNA molecule.

In certain embodiments, the first gRNA molecule and the at least one eaCas9 nickase molecule associate with the target nucleic acid and generate the first single strand break, and the second gRNA molecule and the at least one eaCas9 nickase molecule associate with the target nucleic acid and generate the second single strand break.

In some embodiments, the at least one eaCas9 nickase molecule comprises N-terminal RuvC-like domain cleavage activity but has no HNH-like domain cleavage activity. In other embodiments, the at least one Cas9 molecule comprises an amino acid mutation at an amino acid position corresponding to amino acid position N863 of *Streptococcus pyogenes* Cas9.

In some embodiments, the first gRNA molecule and the at least one eaCas9 nickase molecule associate with a first PAM sequence in the target nucleic acid, wherein the first PAM sequence is facing outward, and the second gRNA molecule and the at least one eaCas9 nickase molecule associate with a second PAM sequence in the target nucleic acid, wherein the second PAM sequence is facing outward.

In some embodiments, the step of processing the first 3' overhang and the second 3' overhang comprises contacting the cell with a Trex2 molecule. In some embodiments, the Trex2 molecule comprises an amino acid sequence that is at least 85% identical to the amino acid sequence of SEQ ID NO:255. In other embodiments, the Trex2 molecule comprises a nucleic acid sequence that is at least 85% identical to the nucleic acid sequence of SEQ ID NO:256.

In some embodiments, the method does not comprise contacting the cell with a library comprising more than ten species of gRNA molecules. In other embodiments, cell is contacted with two species of gRNA molecules.

In some embodiments, the Trex2 molecule does not cause off-target mutagenesis.

In some embodiments, the cell is a mammalian cell. In other embodiments, the mammalian cell is a human cell.

In some embodiments, the segment of the target nucleic acid being deleted comprises a frameshift, an exon, a regulatory element, a splice donor, a splice acceptor, or a sequence that forms a secondary structure. In some embodiments, the secondary structure is a hairpin.

In some embodiments, the method further comprises sequencing the target nucleic acid, or portion of the target nucleic acid, prior to the generating step and after the repair.

In some embodiments, the cell is a population of cells, and wherein 20%-40% of cells in the population of cells comprise a deletion of the segment of the target nucleic acid that was located between the first single strand break and the second single strand break following the repair.

In one aspect, the present disclosure provides a cell modified by the method as described herein. In another aspect, the present disclosure provides a pharmaceutical composition comprising the cell as described herein.

In one aspect, the present disclosure provides a gene editing system comprising a first gRNA molecule and a second gRNA molecule; at least one nickase molecule; and an exonuclease molecule; wherein the first gRNA molecule and the at least one nickase molecule can associate with a target nucleic acid and generate a first single strand break on a first strand of the target nucleic acid; wherein the second gRNA molecule and the at least one nickase molecule can associate with the target nucleic acid and generate a second single strand break on a second strand of the target nucleic acid, thereby forming a double strand break in the target nucleic acid having a first 3' overhang and a second 3' overhang; wherein the exonuclease molecule can process the first 3' overhang and the second 3' overhang, thereby deleting the segment of the target nucleic acid that was located between the first single strand break and the second single strand break and forming a processed double strand break; and wherein the processed double strand break can be repaired by at least one DNA repair pathway.

In some embodiments, the at least one nickase molecule is at least one enzymatically active Cas9 (eaCas9) nickase molecule, or fragment thereof. In other embodiments, the at least one eaCas9 nickase molecule, or fragment thereof, has N-terminal RuvC-like domain cleavage activity but no HNH-like domain cleavage activity. In yet another embodiment, the at least one eaCas9 nickase molecule, or fragment thereof, comprises an amino acid mutation at an amino acid position corresponding to amino acid position N863 of *Streptococcus pyogenes* Cas9.

In some embodiments, the at least one eaCas9 nickase molecule, or fragment thereof, is at least one eaCas9 polypeptide, or a fragment thereof. In other embodiments, the at least one eaCas9 nickase molecule, or fragment thereof, is a nucleic acid encoding an eaCas9 polypeptide.

In some embodiments, the first gRNA molecule and the at least one eaCas9 nickase molecule are a first pre-formed complex, and wherein the second gRNA molecule and the at least one eaCas9 nickase molecule are a second pre-formed complex.

In some embodiments, the exonuclease molecule is a Trex2 polypeptide, or a fragment thereof. In other embodiments, the Trex2 polypeptide comprises an amino acid sequence that is at least 85% identical to the amino acid sequence of SEQ ID NO:255. In some embodiments, the exonuclease molecule is a nucleic acid encoding a Trex2 polypeptide, or a fragment thereof. In other embodiments, the nucleic acid encoding the Trex2 polypeptide comprises a nucleic acid sequence that is at least 85% identical to the nucleic acid sequence of SEQ ID NO:256.

In some embodiments, the gene editing system does not comprise more than four different species of gRNA molecules.

In some embodiments, the segment of the target nucleic acid that was located between the first single strand break and the second single strand break is at least about 10, 20, 50, 75, or 100 base pairs in length.

In some embodiments, the first gRNA molecule, the second gRNA molecule, and the at least one eaCas9 nickase molecule are associated in a pre-formed ribonucleoprotein complex, and wherein the exonuclease molecule is a Trex2 polypeptide, or a fragment thereof. In other embodiments, the first gRNA molecule, the second gRNA molecule, and the at least one eaCas9 nickase molecule are associated in a pre-formed ribonucleoprotein complex, and wherein the exonuclease molecule is nucleic acid encoding a Trex2 polypeptide, or a fragment thereof. In some embodiments, the pre-formed ribonucleoprotein complex is delivered directly to the cell. In other embodiment, the exonuclease molecule is delivered virally.

In one aspect, the present disclosure provides a polynucleotide encoding the gene editing system as described herein. In another aspect, the present disclosure provides a vector encoding the gene editing system as described herein. In yet another aspect, the present disclosure provides a lipid particle comprising the gene editing system as described herein.

In another aspect, the present disclosure provides a pharmaceutical composition comprising the gene editing system as described herein.

In one aspect, the present disclosure provides a gene editing vector system comprising: a first gRNA molecule and a second gRNA molecule; at least one nickase molecule; and an exonuclease molecule; wherein the first gRNA molecule and the at least one nickase molecule can associate with a target nucleic acid and generate a first single strand break on a first strand of the target nucleic acid; wherein the second gRNA molecule and the at least one nickase molecule can associate with the target nucleic acid and generate a second single strand break on a second strand of the target nucleic acid, thereby forming a double strand break in the target nucleic acid having a first 3' overhang and a second 3' overhang; wherein the exonuclease molecule can process the first 3' overhang and the second 3' overhang, thereby deleting the segment of the target nucleic acid that was located between the first single strand break and the second single strand break and forming a processed double strand break; and wherein the processed double strand break can be repaired by at least one DNA repair pathway. In one embodiment, the gene editing vector system comprises at least two vectors comprising nucleic acids encoding the components of the system. In another embodiment, the gene editing vector system comprises at least three vectors comprising nucleic acids encoding the components of the system.

In some embodiments, the at least one nickase molecule is at least one enzymatically active Cas9 (eaCas9) nickase molecule, or fragment thereof. In other embodiments, the at least one eaCas9 nickase molecule, or fragment thereof, has N-terminal RuvC-like domain cleavage activity but no HNH-like domain cleavage activity. In yet another embodiment, the at least one eaCas9 nickase molecule, or fragment thereof, comprises an amino acid mutation at an amino acid position corresponding to amino acid position N863 of *Streptococcus pyogenes* Cas9.

In some embodiments, the at least one eaCas9 nickase molecule, or fragment thereof, is at least one eaCas9 polypeptide, or a fragment thereof. In other embodiments, the at least one eaCas9 nickase molecule, or fragment thereof, is a nucleic acid encoding an eaCas9 polypeptide.

In some embodiments, the first gRNA molecule and the at least one eaCas9 nickase molecule are a first pre-formed complex, and wherein the second gRNA molecule and the at least one eaCas9 nickase molecule are a second pre-formed complex.

In some embodiments, the exonuclease molecule is a Trex2 polypeptide, or a fragment thereof. In other embodiments, the Trex2 polypeptide comprises an amino acid sequence that is at least 85% identical to the amino acid sequence of SEQ ID NO:255. In some embodiments, the exonuclease molecule is a nucleic acid encoding a Trex2 polypeptide, or a fragment thereof. In other embodiments, the nucleic acid encoding the Trex2 polypeptide comprises a nucleic acid sequence that is at least 85% identical to the nucleic acid sequence of SEQ ID NO:256.

In some embodiments, the isolated polynucleotide does not comprise more than four different species of gRNA molecules.

In some embodiments, the segment of the target nucleic acid that was located between the first single strand break and the second single strand break is at least about 10, 20, 50, 75, or 100 base pairs in length.

In some embodiments, the first gRNA molecule, the second gRNA molecule, and the at least one eaCas9 nickase molecule are associated in a pre-formed ribonucleoprotein complex, and wherein the exonuclease molecule is a Trex2 polypeptide, or a fragment thereof. In other embodiments, the first gRNA molecule, the second gRNA molecule, and the at least one eaCas9 nickase molecule are associated in a pre-formed ribonucleoprotein complex, and wherein the exonuclease molecule is nucleic acid encoding a Trex2 polypeptide, or a fragment thereof. In some embodiments, the pre-formed ribonucleoprotein complex is delivered directly to the cell. In other embodiment, the exonuclease molecule is delivered virally.

In some embodiments, the gene editing system comprises one or more polynucleotides encoding the first gRNA molecule, the second gRNA molecule, and the at least one eaCas9 nickase molecule. Alternatively, the gene editing system comprises the first gRNA molecule, the second gRNA molecule, and the at least one Cas9 nickase molecule, which are associated in a pre-formed ribonucleoprotein complex. In some embodiments, the gene editing vector system comprises a polynucleotide encoding the exonuclease molecule, e.g., a Trex2 polypeptide, or a fragment thereof. Alternatively, the gene editing vector system may comprise a Trex2 polypeptide, or fragment thereof.

In another aspect, the present disclosure provides an isolated polynucleotide, encoding: a first gRNA molecule and a second gRNA molecule; at least one nickase molecule; and an exonuclease molecule; wherein the first gRNA molecule and the at least one nickase molecule can associate with a target nucleic acid and generate a first single strand break on a first strand of the target nucleic acid; wherein the second gRNA molecule and the at least one nickase molecule can associate with the target nucleic acid and generate a second single strand break on a second strand of the target nucleic acid, thereby forming a double strand break in the target nucleic acid having a first 3' overhang and a second 3' overhang; wherein the exonuclease molecule can process the first 3' overhang and the second 3' overhang, thereby deleting the segment of the target nucleic acid that was located between the first single strand break and the second single strand break and forming a processed double strand break; and wherein the processed double strand break can be repaired by at least one DNA repair pathway.

In some embodiments, the at least one nickase molecule is at least one enzymatically active Cas9 (eaCas9) nickase molecule, or fragment thereof. In other embodiments, the at least one eaCas9 nickase molecule, or fragment thereof, has N-terminal RuvC-like domain cleavage activity but no HNH-like domain cleavage activity. In yet another embodiment, the at least one eaCas9 nickase molecule, or fragment thereof, comprises an amino acid mutation at an amino acid position corresponding to amino acid position N863 of *Streptococcus pyogenes* Cas9.

In some embodiments, the at least one eaCas9 nickase molecule, or fragment thereof, is at least one eaCas9 polypeptide, or a fragment thereof. In other embodiments, the at least one eaCas9 nickase molecule, or fragment thereof, is a nucleic acid encoding an eaCas9 polypeptide.

In some embodiments, the first gRNA molecule and the at least one eaCas9 nickase molecule are a first pre-formed complex, and wherein the second gRNA molecule and the at least one eaCas9 nickase molecule are a second pre-formed complex.

In some embodiments, the exonuclease molecule is a Trex2 polypeptide, or a fragment thereof. In other embodiments, the Trex2 polypeptide comprises an amino acid sequence that is at least 85% identical to the amino acid sequence of SEQ ID NO:255. In some embodiments, the exonuclease molecule is a nucleic acid encoding a Trex2 polypeptide, or a fragment thereof. In other embodiments, the nucleic acid encoding the Trex2 polypeptide comprises a nucleic acid sequence that is at least 85% identical to the nucleic acid sequence of SEQ ID NO:256.

In some embodiments, the isolated polynucleotide does not comprise more than four different species of gRNA molecules.

In some embodiments, the segment of the target nucleic acid that was located between the first single strand break and the second single strand break is at least about 10, 20, 50, 75, or 100 base pairs in length.

In some embodiments, the first gRNA molecule, the second gRNA molecule, and the at least one eaCas9 nickase molecule are associated in a pre-formed ribonucleoprotein complex, and wherein the exonuclease molecule is a Trex2 polypeptide, or a fragment thereof. In other embodiments, the first gRNA molecule, the second gRNA molecule, and the at least one eaCas9 nickase molecule are associated in a pre-formed ribonucleoprotein complex, and wherein the exonuclease molecule is nucleic acid encoding a Trex2 polypeptide, or a fragment thereof. In some embodiments, the pre-formed ribonucleoprotein complex is delivered directly to the cell. In other embodiment, the exonuclease molecule is delivered virally.

In one aspect, the present disclosure provides a method of treating a patient. The method comprises generating, within a cell of the patient, a first single strand break on a first strand of the target nucleic acid and a second single strand break on a second strand of the target nucleic acid, wherein the first single strand break is located at least 5 base pairs away from the second single strand break, thereby forming a double strand break in the target nucleic acid having a first 3' overhang and a second 3' overhang; and processing the first 3' overhang and the second 3' overhang with an exonuclease molecule, thereby deleting the segment of the target nucleic acid that was located between the first single strand break and the second single strand break and forming a processed double strand break; and allowing the processed double strand break to be repaired by at least one DNA repair pathway, wherein the segment of the target nucleic acid between the first and second single strand breaks is deleted from the target nucleic acid in a cell.

In one aspect, the present disclosure provides a method of treating a patient. The method comprises generating, within a cell of the patient, a first single strand break on a first strand of the target nucleic acid and a second single strand break on a second strand of the target nucleic acid, wherein the first single strand break is located at least 5 base pairs away from the second single strand break, thereby forming a double strand break in the target nucleic acid having a first 3' overhang and a second 3' overhang; and processing the first 3' overhang and the second 3' overhang with an exonuclease molecule, thereby deleting the segment of the target nucleic acid that was located between the first single strand break and the second single strand break and forming a processed double strand break; wherein the processed double strand break can be repaired by at least one DNA repair pathway, and wherein the segment of the target nucleic acid between the first and second single strand breaks is deleted from the target nucleic acid in a cell.

In some embodiments, the processed double strand break are made under conditions that permit the repair of the double strand break.

In some embodiments, the segment of the target nucleic acid that is located between the first single strand break and the second single strand break is 25, 37, 47, or 61 base pairs in length. In other embodiments, the segment of the target nucleic acid that is located between the first single strand break and the second single strand break is at least about 10, 15, 20, 30, 40, 50, 75, 100, 150, 200, 250, 300, 400, 500, 750, 1000, 2000, 3000, 4000, 5000, 6000, 7000, 8000, 9000, 10000, 50000, 100000, 250000, 500000, 750000, 1000000, 2000000, 3000000, 4000000, 5000000, 6000000, 7000000, 8000000, 9000000, or 10000000 base pairs in length.

In some embodiments, the target nucleic acid is a promoter region of a gene, a coding region of a gene, a non-coding region of a gene, an intron of a gene, or an exon of a gene.

In some embodiments, the step of generating the first single strand break and the second single strand break comprises contacting the cell with a first gRNA molecule, at least one enzymatically active Cas9 (eaCas9) nickase molecule, and a second gRNA molecule.

In certain embodiments, the first gRNA molecule and the at least one eaCas9 nickase molecule associate with the target nucleic acid and generate the first single strand break, and wherein the second gRNA molecule and the at least one eaCas9 nickase molecule associate with the target nucleic acid and generate the second single strand break.

In some embodiments, the at least one eaCas9 nickase molecule comprises N-terminal RuvC-like domain cleavage activity but has no HNH-like domain cleavage activity. In other embodiments, the at least one Cas9 molecule comprises an amino acid mutation at an amino acid position corresponding to amino acid position N863 of *Streptococcus pyogenes* Cas9.

In some embodiments, the step of processing the first 3' overhang and the second 3' overhang comprises contacting the cell with a Trex2 molecule. In some embodiments, the Trex2 molecule comprises an amino acid sequence that is at least 85% identical to the amino acid sequence of SEQ ID NO:255. In other embodiments, the Trex2 molecule comprises a nucleic acid sequence that is at least 85% identical to the nucleic acid sequence of SEQ ID NO:256.

In some embodiments, the method does not comprise contacting the cell with a library comprising more than ten species of gRNA molecules. In other embodiments, cell is contacted with two species of gRNA molecules.

In some embodiments, the Trex2 molecule does not cause off-target mutagenesis.

In some embodiments, the cell is a mammalian cell. In other embodiments, the mammalian cell is a human cell.

In some embodiments, the segment of the target nucleic acid being deleted comprises a frameshift, an exon, a regulatory element, a splice donor, a splice acceptor, or a sequence that forms a secondary structure. In some embodiments, the secondary structure is a hairpin.

In some embodiments, the method further comprises sequencing the target nucleic acid, or portion of the target nucleic acid, prior to the generating step and after the repair.

In some embodiments, the cell is a population of cells, and wherein 20%-40% of cells in the population of cells comprise a deletion of the segment of the target nucleic acid that was located between the first single strand break and the second single strand break following the repair.

In one aspect, the present disclosure provides a composition, comprising a first gRNA molecule and a second gRNA molecule; at least one eaCas9 nickase molecule; and a Trex2 molecule; wherein the first gRNA molecule and the at least one eaCas9 nickase molecule can associate with a target nucleic acid and generate a first single strand break on a first strand of the target nucleic acid; wherein the second gRNA molecule and the at least one eaCas9 nickase molecule can associate with the target nucleic acid and generate a second single strand break on a second strand of the target nucleic acid, thereby forming a double strand break in the target nucleic acid having a first 3' overhang and a second 3' overhang; wherein the Trex2 molecule can process the first 3' overhang and the second 3' overhang, thereby deleting a segment of the target nucleic acid that is located between the first single strand break and the second single strand break and forming a processed double strand break; and wherein the processed double strand break can be repaired by at least one DNA repair pathway.

In some embodiments, the at least one nickase molecule is at least one enzymatically active Cas9 (eaCas9) nickase molecule, or fragment thereof. In other embodiments, the at least one eaCas9 nickase molecule, or fragment thereof, has N-terminal RuvC-like domain cleavage activity but no HNH-like domain cleavage activity. In yet another embodiment, the at least one eaCas9 nickase molecule, or fragment thereof, comprises an amino acid mutation at an amino acid position corresponding to amino acid position N863 of *Streptococcus pyogenes* Cas9.

In some embodiments, the at least one eaCas9 nickase molecule, or fragment thereof, is at least one eaCas9 polypeptide, or a fragment thereof. In other embodiments, the at least one eaCas9 nickase molecule, or fragment thereof, is a nucleic acid encoding an eaCas9 polypeptide.

In some embodiments, the first gRNA molecule and the at least one eaCas9 nickase molecule are a first pre-formed complex, and wherein the second gRNA molecule and the at least one eaCas9 nickase molecule are a second pre-formed complex.

In some embodiments, the Trex2 molecule is a Trex2 polypeptide, or a fragment thereof. In other embodiments, the Trex2 polypeptide comprises an amino acid sequence that is at least 85% identical to the amino acid sequence of SEQ ID NO:255. In some embodiments, the Trex2 molecule is a nucleic acid encoding a Trex2 polypeptide, or a fragment thereof. In other embodiments, the nucleic acid encoding the Trex2 polypeptide comprises a nucleic acid sequence that is at least 85% identical to the nucleic acid sequence of SEQ ID NO:256.

In some embodiments, the composition does not comprise more than four different species of gRNA molecules.

In some embodiments, the segment of the target nucleic acid that was located between the first single strand break and the second single strand break is at least about 10, 20, 50, 75, or 100 base pairs in length.

In some embodiments, the first gRNA molecule, the second gRNA molecule, and the at least one eaCas9 nickase molecule are associated in a pre-formed ribonucleoprotein complex, and wherein the Trex2 molecule is a Trex2 polypeptide, or a fragment thereof. In other embodiments, the first gRNA molecule, the second gRNA molecule, and the at least one eaCas9 nickase molecule are associated in a pre-formed ribonucleoprotein complex, and wherein the Trex2 molecule is nucleic acid encoding a Trex2 polypeptide, or a fragment thereof. In some embodiments, the pre-formed ribonucleoprotein complex is delivered directly to the cell. In other embodiment, the exonuclease molecule is delivered virally.

In one aspect, the present disclosure provides a gene editing system. The gene editing system may comprise paired nickases configured to form a DNA double strand break having a 3' overhang; and a 3' to 5' exonuclease. The paired nickases may be Cas9 nickases having RuvC activity but not HNH activity. In other embodiments, the Cas9 nickases are *S. pyogenes* N863A mutants. The 3' to 5' exonuclease is Trex2. In other embodiments, the Trex2 is recombinant human Trex2.

In some embodiments, the gene editing system is carried by a lipid particle. For example, the lipid particle may be a vector, e.g., a lentivirus vector.

In one aspect, the present disclosure provides a composition comprising one or more nucleotides encoding a Cas9 nickase, first and second gRNAs, and a Trex2 exonuclease. In some embodiments, the Cas9 nickase has RuvC activity but not HNH activity.

In one aspect, described herein is a method of altering a nucleic acid at a target position in a cell, or a population of cells, the method comprising contacting the cell, or the population of cells, with (a) a gRNA molecule; (b) a Cas9 molecule; and (c) a Trex2 molecule; wherein the gRNA molecule and the Cas9 molecule interact with the nucleic acid, resulting in a cleavage event, wherein the cleavage event is resolved or repaired by at least one DNA repair pathway, and wherein the sequence of the nucleic acid after the cleavage event is different than the sequence of the nucleic acid prior to the cleavage event, thereby altering the nucleic acid at the target position in the cell, or in the population of cells. In one embodiment, the Trex2 molecule is a heterologous Trex2 molecule.

In one embodiment, the method further comprises contacting the cell, or the population of cells, with (d) a second gRNA molecule. In one embodiment, the second gRNA molecule and the Cas9 molecule interact with the nucleic acid, resulting in a second cleavage event. In another embodiment, the second gRNA molecule and the Cas9 molecule interact at the nucleic acid and do not cause a cleavage event. In one embodiment, the second gRNA molecule is a second gRNA nucleic acid.

In another embodiment, the method further comprises a third gRNA molecule. In one embodiment, the third gRNA molecule and the Cas9 molecule interact at the nucleic acid, resulting in a third cleavage event. In another embodiment, the third gRNA molecule and the Cas9 molecule interact at the nucleic acid and do not cause a cleavage event.

In yet another embodiment, the method further comprises a fourth gRNA molecule. In one embodiment, the fourth gRNA molecule and the Cas9 molecule interact at the nucleic acid, resulting in a fourth cleavage event. In another embodiment, the fourth gRNA molecule and the Cas9 molecule interact at the nucleic acid and do not cause a cleavage event.

In one embodiment, the at least one DNA repair pathway is selected from the group consisting of: resection, mismatch repair (MMR), nucleotide excision repair (NER), base excision repair (BER), canonical non-homologous end joining (canonical NHEJ), alternative non-homologous end joining (ALT-NHEJ), canonical homology directed-repair (canonical HDR), alternative homology directed repair (ALT-HDR), microhomology-mediated end joining (MMEJ), Blunt End Joining, Synthesis Dependent Microhomology Mediated End Joining, single strand annealing (SSA), Holliday junction model or double strand break repair (DSBR), synthesis-dependent strand annealing (SDSA), single strand break repair (SSBR), translesion synthesis repair (TLS), and interstrand crosslink repair (ICL).

In one embodiment, the at least one DNA repair pathway is canonical NHEJ. In another embodiment, the at least one DNA repair pathway is ALT-NHEJ. In another embodiment, the at least one DNA repair pathway is canonical HDR. In another embodiment, the at least one DNA repair pathway is ALT-HDR. In yet another embodiment, the at least one DNA repair pathway is SSA.

In one embodiment, the sequence of the nucleic acid after the cleavage event comprises a deletion as compared to the sequence of the nucleic acid prior to the cleavage event. In one embodiment, the deletion is at least about 1, 2, 3, 4, 5, 6, 7, 8, 9, 10, 15, 20, 30, 40, 50, 75, 100, 200, 300, 400, 500, 750, 1000, 2000, 3000, 4000, 5000, 6000, 7000, 8000, 9000, 10000, 15000, 20000, 25000, 30000, 40000, 50000, 60000, 70000, 80000, 90000, 100000, 200000, 300000, 400000, 500000, 600000, 700000, 800000, 900000, or 1000000 nucleotides in length. In one embodiment, the deletion is 47 nucleotides in length. In one embodiment, the frequency of the deletion is increased in the population of cells comprising the Trex2 molecule, as compared to the frequency of a deletion at the target position after resolution or repair of a cleavage event in a population of cells that does not comprise the Trex2 molecule. In one embodiment, the frequency of the nucleotide deletion is increased at least about two-fold in the population of cells comprising the Trex2 molecule, as compared to the frequency of a nucleotide deletion at the target position after resolution or repair of a cleavage event in a population of cells that does not comprise the Trex2 molecule. In another embodiment, the frequency of the nucleotide deletion is increased by at least about 10%, 20%, 25%, 30%, 40%, 50%, 60%, 70%, 75%, 80%, 90%, 2-fold, 3-fold, 4-fold, 5-fold, 6-fold, 7-fold, 8-fold, 9-fold, or 10-fold in the population of cells comprising the Trex2 molecule, as compared to the frequency of a nucleotide deletion at the target position after resolution or repair of a cleavage event in a population of cells that does not comprise the Trex2 molecule.

In one embodiment, the frequency of the cleavage event being resolved or repaired by ALT-NHEJ is increased in the population of cells comprising the Trex2 molecule, as compared to the frequency of the cleavage event being resolved or repaired by ALT-NHEJ in a population of cells that does not comprise the Trex2 molecule. In another embodiment, the frequency of the cleavage event being resolved or repaired by ALT-NHEJ is decreased by at least about 10%, 20%, 25%, 30%, 40%, 50%, 60%, 70%, 75%, 80%, 90%, 2-fold, 3-fold, 4-fold, 5-fold, 6-fold, 7-fold, 8-fold, 9-fold, or 10-fold in the population of cells comprising the Trex2 molecule, as compared to the frequency of the cleavage event being resolved or repaired by ALT-NHEJ in a population of cells that does not comprise the Trex2 molecule. In one embodiment, the Cas9 molecule causing the cleavage event is a N863A Cas9 molecule.

In one embodiment, the frequency of the cleavage event being resolved or repaired by canonical HDR is decreased in the population of cells comprising the Trex2 molecule, as compared to the frequency of the cleavage event being resolved or repaired by canonical HDR in a population of cells that does not comprise the Trex2 molecule. In another embodiment, the frequency of the cleavage event being resolved or repaired by canonical HDR is decreased by at least about 10%, 20%, 25%, 30%, 40%, 50%, 60%, 70%, 75%, 80%, 90%, 2-fold, 3-fold, 4-fold, 5-fold, 6-fold, 7-fold, 8-fold, 9-fold, or 10-fold in the population of cells comprising the Trex2 molecule, as compared to the frequency of the cleavage event being resolved or repaired by canonical HDR in a population of cells that does not comprise the Trex2 molecule.

In one embodiment, the sequence of the nucleic acid after the cleavage event comprises an insertion as compared to the sequence of the nucleic acid prior to the cleavage event. In one embodiment, the frequency of the insertion is decreased in the population of cells comprising the Trex2 molecule, as compared to the frequency of the insertion in a population of cells that does not comprise the Trex2 molecule. In another embodiment, the frequency of the insertion is decreased by at least about 10%, 20%, 25%, 30%, 40%, 50%, 60%, 70%, 75%, 80%, 90%, 2-fold, 3-fold, 4-fold, 5-fold, 6-fold, 7-fold, 8-fold, 9-fold, or 10-fold in the population of cells comprising the Trex2 molecule, as compared to the frequency of the insertion in a population of cells that does not comprise the Trex2 molecule.

In one embodiment, the cleavage event results in a 5' overhang on the nucleic acid. In another embodiment, the cleavage event results in a 3' overhang on the nucleic acid.

In one embodiment, the Trex2 molecule has exonuclease activity. In another embodiment, the Trex2 molecule has 3' exonuclease activity.

In one embodiment, the Trex2 molecule comprises an amino acid sequence that is at least 85% identical to SEQ ID NO: 255. In one embodiment, the Trex2 molecule comprises an amino acid sequence that is identical to SEQ ID NO: 255. In another embodiment, the Trex2 molecule consists of an amino acid sequence that is identical to SEQ ID NO: 255.

In one embodiment, the Trex2 molecule is a nucleic acid molecule encoding a Trex2 protein. In one embodiment, the nucleic acid molecule encoding the Trex2 protein comprises a sequence that is at least 85% identical to SEQ ID NO:256. In another embodiment, the nucleic acid molecule encoding the Trex2 protein comprises SEQ ID NO:256. In yet another embodiment, the nucleic acid molecule encoding the Trex2 protein consists of SEQ ID NO:256.

In one embodiment, the nucleic acid molecule is a DNA molecule. In another embodiment, the DNA molecule is located on a plasmid. In another embodiment, the nucleic acid molecule is an RNA molecule. In another embodiment, the RNA molecule is an mRNA molecule.

In one embodiment, the cleavage event comprises one or more single strand breaks, one or more double strand breaks, or a combination of single strand breaks and double strand breaks. In another embodiment, the cleavage event comprises any one of the following: one single strand break; two single strand breaks; three single strand breaks; four single strand breaks; one double strand break; two double strand breaks; one single strand break and one double strand break; two single strand breaks and one double strand break; or any combination thereof.

In one embodiment, the gRNA molecule positions one cleavage event on each strand of the nucleic acid.

In one embodiment, the cleavage event flanks the target position, and wherein a terminus created by the cleavage event is a 5' terminus. In another embodiment, the cleavage event results in a 5' overhang.

In one embodiment, the cleavage event flanks the target position, and wherein a terminus created by the cleavage event is a 3' terminus. In another embodiment, the cleavage event results in a 3' overhang.

In one embodiment, the distance between the cleavage event and the target position is between 10 and 10000 nucleotides, between 50 and 5000 nucleotides, between 100 and 1000 nucleotides, between 200 and 800 nucleotides, between 400 and 600 nucleotides, between 100 and 500 nucleotides, or between 500 and 1000 nucleotides in length. In another embodiment, the distance between the cleavage event and the target position is at least about 10, 20, 30, 40, 50, 75, 100, 200, 300, 400, 500, 750, 1000, 2000, 3000, 4000, 5000, 6000, 7000, 8000, 9000, 10000, 15000, 20000, 25000, 30000, 40000, 50000, 60000, 70000, 80000, 90000, 100000, 200000, 300000, 400000, 500000, 600000, 700000, 800000, 900000, or 1000000 nucleotides in length.

In one embodiment, the cleavage event comprises a single strand break, and wherein the distance between the single strand break and the target position is between 10 and 10000 nucleotides, between 50 and 5000 nucleotides, between 100 and 1000 nucleotides, between 200 and 800 nucleotides, between 400 and 600 nucleotides, between 100 and 500 nucleotides, or between 500 and 1000 nucleotides in length. In another embodiment, the cleavage event comprises a single strand break, and wherein the distance between the single strand break and the target position is at least about 10, 20, 30, 40, 50, 75, 100, 200, 300, 400, 500, 750, 1000, 2000, 3000, 4000, 5000, 6000, 7000, 8000, 9000, 10000, 15000, 20000, 25000, 30000, 40000, 50000, 60000, 70000, 80000, 90000, 100000, 200000, 300000, 400000, 500000, 600000, 700000, 800000, 900000, or 1000000 nucleotides in length.

In one embodiment, the cleavage event comprises two, three, or four single strand breaks, and wherein the distance between each of the single strand breaks and the target position is between 10 and 10000 nucleotides, between 50 and 5000 nucleotides, between 100 and 1000 nucleotides, between 200 and 800 nucleotides, between 400 and 600 nucleotides, between 100 and 500 nucleotides, or between 500 and 1000 nucleotides in length. In another embodiment, the cleavage event comprises two, three, or four single strand breaks, and wherein the distance between each of the single strand breaks and the target position is at least about 10, 20, 30, 40, 50, 75, 100, 200, 300, 400, 500, 750, 1000, 2000, 3000, 4000, 5000, 6000, 7000, 8000, 9000, 10000, 15000, 20000, 25000, 30000, 40000, 50000, 60000, 70000, 80000, 90000, 100000, 200000, 300000, 400000, 500000, 600000, 700000, 800000, 900000, or 1000000 nucleotides in length.

In one embodiment, the cleavage event comprises a double strand break, and wherein the distance between the double strand break and the target position is between 10 and 10000 nucleotides, between 50 and 5000 nucleotides, between 100 and 1000 nucleotides, between 200 and 800 nucleotides, between 400 and 600 nucleotides, between 100 and 500 nucleotides, or between 500 and 1000 nucleotides in length. In another embodiment, the cleavage event comprises a double strand break, and wherein the distance between the double strand break and the target position is at least about 10, 20, 30, 40, 50, 75, 100, 200, 300, 400, 500, 750, 1000, 2000, 3000, 4000, 5000, 6000, 7000, 8000, 9000, 10000, 15000, 20000, 25000, 30000, 40000, 50000, 60000, 70000, 80000, 90000, 100000, 200000, 300000, 400000, 500000, 600000, 700000, 800000, 900000, or 1000000 nucleotides in length.

In one embodiment, the cleavage event comprises two double strand breaks, and wherein the distance between each of the double strand breaks and the target position is between 10 and 10000 nucleotides, between 50 and 5000 nucleotides, between 100 and 1000 nucleotides, between 200 and 800 nucleotides, between 400 and 600 nucleotides, between 100 and 500 nucleotides, or between 500 and 1000 nucleotides in length. In another embodiment, the cleavage event comprises two double strand breaks, and wherein the distance between each of the double strand breaks and the target position is at least about 10, 20, 30, 40, 50, 75, 100, 200, 300, 400, 500, 750, 1000, 2000, 3000, 4000, 5000, 6000, 7000, 8000, 9000, 10000, 15000, 20000, 25000, 30000, 40000, 50000, 60000, 70000, 80000, 90000, 100000, 200000, 300000, 400000, 500000, 600000, 700000, 800000, 900000, or 1000000 nucleotides in length.

In one embodiment, the cleavage event comprises a single strand break and a double strand break, wherein the distance between the single strand break and the target position is between 10 and 10000 nucleotides, between 50 and 5000 nucleotides, or between 100 and 1000 nucleotides in length, and wherein the distance between the double strand break and the target position is between 10 and 10000 nucleotides, between 50 and 5000 nucleotides, or between 100 and 1000 nucleotides in length. In another embodiment, the cleavage event comprises a single strand break and a double strand break, wherein the distance between the single strand break and the target position is about 10, 20, 30, 40, 50, 75, 100, 200, 300, 400, 500, 750, 1000, 2000, 3000, 4000, 5000, 6000, 7000, 8000, 9000, 10000, 15000, 20000, 25000, 30000, 40000, 50000, 60000, 70000, 80000, 90000, 100000, 200000, 300000, 400000, 500000, 600000, 700000, 800000, 900000, or 1000000 nucleotides in length, and wherein the distance between the double strand break and the target position is at least about 10, 20, 30, 40, 50, 75, 100, 200, 300, 400, 500, 750, 1000, 2000, 3000, 4000, 5000, 6000, 7000, 8000, 9000, 10000, 15000, 20000, 25000, 30000, 40000, 50000, 60000, 70000, 80000, 90000, 100000, 200000, 300000, 400000, 500000, 600000, 700000, 800000, 900000, or 1000000 nucleotides in length.

In one embodiment, the cleavage event comprises two single strand breaks and a double strand break, wherein the distance between each of the single strand breaks and the target position is between 10 and 10000 nucleotides, between 50 and 5000 nucleotides or between 100 and 1000 nucleotides in length, and wherein the distance between the double strand break and the target position is between 10 and 10000 nucleotides in length, between 50 and 5000 nucleotides or between 100 and 1000 nucleotides in length. In another embodiment, the cleavage event comprises two single strand breaks and a double strand break, wherein the distance between each of the single strand breaks and the target position is at least about 10, 20, 30, 40, 50, 75, 100, 200, 300, 400, 500, 750, 1000, 2000, 3000, 4000, 5000, 6000, 7000, 8000, 9000, 10000, 15000, 20000, 25000, 30000, 40000, 50000, 60000, 70000, 80000, 90000, 100000, 200000, 300000, 400000, 500000, 600000, 700000, 800000, 900000, or 1000000 nucleotides in length, and wherein the distance between the double strand break and the target position is at least about 10, 20, 30, 40, 50, 75, 100, 200, 300, 400, 500, 750, 1000, 2000, 3000, 4000, 5000, 6000, 7000, 8000, 9000, 10000, 15000, 20000, 25000, 30000, 40000, 50000, 60000, 70000, 80000, 90000, 100000, 200000, 300000, 400000, 500000, 600000, 700000, 800000, 900000, or 1000000 nucleotides in length.

In one embodiment, the cleavage event comprises two or more single strand breaks, two or more double strand breaks, or two single strand breaks and one double strand breaks, wherein the distance between any of the two breaks that are present on the same strand is between 50 and 20000 nucleotides, between 1000 and 10000 nucleotides, or between 500 and 5000 nucleotides in length. In another embodiment, the cleavage event comprises two or more single strand breaks, two or more double strand breaks, or two single strand breaks and one double strand breaks, wherein the distance between any of the two breaks that are present on the same strand is at least about 50, 75, 100, 200, 300, 400, 500, 750, 1000, 2000, 3000, 4000, 5000, 6000, 7000, 8000, 9000, 10000, 15000, 20000, 25000, 30000, 40000, 50000, 60000, 70000, 80000, 90000, 100000, 200000, 300000, 400000, 500000, 600000, 700000, 800000, 900000, or 1000000 nucleotides in length.

In one embodiment, the gRNA molecule positions the cleavage event 3' to the target position on the top strand of the nucleic acid, as shown in the diagram below:

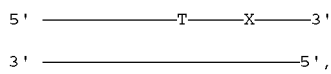

wherein X is the cleavage event and T is the target position.

In one embodiment, a second gRNA molecule positions a second cleavage event 5' to the target position on the bottom strand of the nucleic acid, as shown in the diagram below:

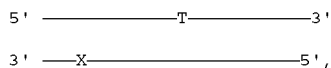

wherein X is the cleavage event and T is the target position. In one embodiment, the gRNA molecule positions the cleavage event 3' to the target position on the top strand of the nucleic acid, and wherein a second gRNA molecule positions a second cleavage event 5' to the target position on the bottom strand of the nucleic acid, resulting in the generation of a first 3' overhang and a second 3' overhang, as shown in the diagram below:

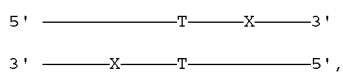

wherein X is the cleavage event and T is the target position.

In one embodiment, the gRNA molecule positions the cleavage event on a strand of the nucleic acid that binds to the gRNA molecule.

In one embodiment, the second gRNA molecule positions the second cleavage event on a strand of the nucleic acid that binds to the second gRNA molecule.

In one embodiment, the gRNA molecule positions the cleavage event on a strand of the nucleic acid that binds to the gRNA molecule, and the second gRNA molecule positions the second cleavage event on a strand of the nucleic acid that binds to the second gRNA molecule, and wherein the gRNA molecule and the second gRNA molecule bind to different strands of the nucleic acid. In another embodiment, the cleavage event results in a 5' overhang on each strand of the nucleic acid.

In one embodiment, the gRNA molecule positions the cleavage event on a strand of the nucleic acid that does not bind to the gRNA molecule.

In one embodiment, the second gRNA molecule positions the second cleavage event on a strand of the nucleic acid that does not bind to the second gRNA molecule.

In one embodiment, the gRNA molecule positions the cleavage event on a strand of the nucleic acid that does not bind to the gRNA, wherein the second gRNA molecule positions the second cleavage event on a strand of the nucleic acid that does not bind to the second gRNA molecule, and wherein the gRNA molecule and the second gRNA molecule bind to different strands of the nucleic acid. In another embodiment, the cleavage event and the second cleavage event result in a 3' overhang on each strand of the nucleic acid.

In one embodiment, the target position is a control region, a coding region, a non-coding region, an intron, or an exon of a gene.

In one embodiment, the eaCas9 molecule comprises HNH-like domain cleavage activity but has no N-terminal RuvC-like domain cleavage activity. In another embodiment, the eaCas9 molecule is an HNH-like domain nickase. In another embodiment, the eaCas9 molecule comprises a mutation at an amino acid position corresponding to amino acid position D10 of *Streptococcus pyogenes* Cas9. In another embodiment, the eaCas9 molecule comprises N-terminal RuvC-like domain cleavage activity but has no HNH-like domain cleavage activity.

In one embodiment, the eaCas9 molecule is an N-terminal RuvC-like domain nickase. In another embodiment, the eaCas9 molecule comprises an amino acid mutation at an amino acid position corresponding to amino acid position H840 or N863 of *S. pyogenes* Cas9.

In one embodiment, the cell, or the population of cells, is a eukaryotic cell, or a population of eukaryotic cells. In another embodiment, the cell, or the population of cells, is a plant cell, or a population of plant cells. In another embodiment, the plant cell, or the population of plant cells, is a monocot plant cell, a dicot plant cell, a population of monocot plant cells, or a population of dicot plant cells.

In one embodiment, the cell, or the population of cells, is a mammalian cell, or a population of mammalian cells. In one embodiment, the cell, or the population of cells, is a human cell, or a population of human cells.

In one embodiment, the cell, or the population of cells, is a vertebrate, mammalian, rodent, goat, pig, bird, chicken, turkey, cow, horse, sheep, fish, primate, or human cell or population of cells. In another embodiment, the cell, or the population of cells, is a somatic cell, a germ cell, or a prenatal cell or population of cells.

In one embodiment, the cell, or the population of cells, is a zygotic cell, a blastocyst, an embryonic cell, a stem cell, a mitotically competent cell, a meiotically competent cell or population of cells.

In one embodiment, the cell, or the population of cells, is a T cell, a CD8+ T cell, a CD8+ naïve T cell, a central memory T cell, an effector memory T cell, a CD4+ T cell, a stem cell memory T cell, a helper T cell, a regulatory T cell, a cytotoxic T cell, a natural killer T cell, a hematopoietic stem cell (HSC), a long term hematopoietic stem cell, a short term hematopoietic stem cell, a multipotent progenitor cell, a lineage restricted progenitor cell, a lymphoid progenitor cell, a myeloid progenitor cell, a common myeloid progenitor cell, an erythroid progenitor cell, a megakaryocyte erythroid progenitor cell, a monocytic precursor cell, an endocrine precursor cell, an exocrine cell, a fibroblast, a retinal cell, a photoreceptor cell, a rod cell, a cone cell, a retinal pigmented epithelium cell, a trabecular meshwork cell, a cochlear hair cell, an outer hair cell, an inner hair cell, a pulmonary epithelial cell, a bronchial epithelial cell, an alveolar epithelial cell, a pulmonary epithelial progenitor cell, a striated muscle cell, a cardiac muscle cell, a muscle satellite cell, a myocyte, a neuron, a neuronal stem cell, a mesenchymal stem cell, an induced pluripotent stem (iPS) cell, an embryonic stem cell, a monocyte, a megakaryocyte, a neutrophil, an eosinophil, a basophil, a mast cell, a reticulocyte, a B cell, e.g. a progenitor B cell, a Pre B cell, a Pro B cell, a memory B cell, a plasma B cell, a gastrointestinal epithelial cell, a biliary epithelial cell, a pancreatic ductal epithelial cell, an intestinal stem cell, a hepatocyte, a liver stellate cell, a Kupffer cell, an osteoblast, an osteoclast, an adipocyte, a preadipocyte, a pancreatic precursor cell, a pancreatic islet cell, a pancreatic beta cell, a pancreatic alpha cell, a pancreatic delta cell, a pancreatic exocrine cell, a Schwann cell, or an oligodendrocyte, or population of such cells.

In one embodiment, the cell, or population of cells, is from a subject suffering from a disease or disorder. In one embodiment, the disease is a blood disease, an immune disease, a neurological disease, a cancer, an infectious disease, a genetic disease, a disorder caused by aberrant mtDNA, a metabolic disease, a disorder caused by aberrant cell cycle, a disorder caused by aberrant angiogenesis, a disorder cause by aberrant DNA damage repair, or a pain disorder.

In one embodiment, the cell, or population of cells, is from a subject having at least one mutation at the target position.

In one embodiment, the gRNA molecule is a gRNA nucleic acid, wherein the Cas9 molecule is a Cas9 nucleic acid, and wherein the Trex2 molecule is a Trex2 nucleic acid.

In one embodiment, the gRNA molecule is a gRNA nucleic acid, wherein the Cas9 molecule is a Cas9 protein, and wherein the Trex2 molecule is a Trex2 nucleic acid.

In one embodiment, the Trex2 molecule is a Trex2 protein, wherein the gRNA molecule is a gRNA nucleic acid, and wherein the Cas9 molecule is a Cas9 nucleic acid.

In one embodiment, the Cas9 molecule is a Cas9 protein, wherein the Trex2 molecule is a Trex2 protein, and wherein the gRNA molecule is a gRNA nucleic acid.

In one embodiment, the gRNA is a gRNA nucleic acid, wherein the Cas9 molecule is a Cas9 protein, and wherein the Trex2 molecule is a Trex2 protein.

In one embodiment, the cell, or the population of cells, is contacted with the gRNA molecule and the Cas9 molecule as a pre-formed complex.

In one embodiment, the target position is between 50 and 10000 nucleotides in length, between 50 and 5000 nucleotides, between 100 and 1000 nucleotides, between 200 and 800 nucleotides, between 400 and 600 nucleotides, between 100 and 500 nucleotides, or between 500 and 1000 nucleotides in length. In another embodiment, the target position is about 10, 20, 30, 40, 50, 75, 100, 200, 300, 400, 500, 750, 1000, 2000, 3000, 4000, 5000, 6000, 7000, 8000, 9000, 10000, 15000, 20000, 25000, 30000, 40000, 50000, 60000, 70000, 80000, 90000, 100000, 200000, 300000, 400000, 500000, 600000, 700000, 800000, 900000, or 1000000 nucleotides in length.

In one embodiment, the cleavage event and the second cleavage event are separated by 10 to 10000, 10 to 5000, 10 to 2500, 10 to 1000, 10 to 750, 10 to 500, 10 to 400, 10 to 300, 10 to 200, 10 to 100, 10 to 75, 10 to 50, or 10 to 25 base pairs.

In one embodiment, the gRNA molecule and the Cas9 molecule interact at the nucleic acid, resulting in a cleavage event on the strand of the nucleic acid other than the strand of the nucleic acid that binds to the gRNA molecule, the second gRNA molecule and the Cas9 molecule interact at the nucleic acid, resulting in a second cleavage event on the strand of the nucleic acid other than the strand of the nucleic acid that binds to the second gRNA molecule, the gRNA molecule and the second gRNA molecule bind to different strands of the nucleic acid, the gRNA molecule positions the cleavage event 5' to the target position on the top strand of the nucleic acid, and the second gRNA molecule positions the second cleavage event 3' to the target position on the bottom strand of the nucleic acid. In one embodiment, the cleavage event and the second cleavage event are separated by 10 to 10000, 10 to 5000, 10 to 2500, 10 to 1000, 10 to 750, 10 to 500, 10 to 400, 10 to 300, 10 to 200, 10 to 100, 10 to 75, 10 to 50, or 10 to 25 base pairs. In one embodiment, the first cleavage event and the second cleavage event occur sequentially. In another embodiment, the first cleavage event and the second cleavage event occur simultaneously.

In another aspect, described herein is a cell, or a population of cells, altered by the methods described herein.

In another aspect, described herein is a composition comprising (a) a gRNA molecule; (b) a Cas9 molecule; and (c) a Trex2 molecule. In one embodiment, the composition further comprises a second gRNA molecule. In another aspect, described herein is a cell, or a population of cells, comprising a composition described herein.

In another aspect, described herein is a cell, or a population of cells, comprising: (a) a gRNA molecule; (b) a Cas9 molecule; and (c) a heterologous Trex2 molecule. In one embodiment, the cell, or population of cells, further comprises a second gRNA molecule.

In another aspect, described herein is a pharmaceutical composition comprising a cell, or a population of cells, described herein.

In another aspect, described herein is a method of treating a subject comprising administering to the subject a cell, or a population of cells, described herein or a pharmaceutical composition described herein.

In another aspect, described herein is a method of treating a subject suffering from a disease or disorder, the method comprising contacting a cell, or a population of cells, from the subject with (a) a gRNA molecule; (b) a Cas9 molecule; and (c) a Trex2 molecule; wherein the gRNA molecule and the Cas9 molecule interact with a nucleic acid at a target position, resulting in a cleavage event, wherein the cleavage event is resolved or repaired by at least one DNA repair pathway, and wherein the sequence of the nucleic acid after the cleavage event is different than the sequence of the nucleic acid prior to the cleavage event, thereby treating the subject suffering from the disease or disorder. In one embodiment, the method further comprises contacting the cell from the subject with a second gRNA molecule, wherein the second gRNA molecule and the Cas9 molecule interact with the nucleic acid, resulting in a second cleavage event. In one embodiment, the contacting occurs ex vivo. In another embodiment, the contacting occurs in vivo. In one embodiment, the subject is a human subject. In one embodiment, the disease is sickle cell disease. In another embodiment, the disease is beta thalassemia.

In one aspect, disclosed herein is a method of modifying the sequence of a target region of a target nucleic acid in a mammalian cell, the method comprising generating, within the cell, a first single strand break on a first strand of the target nucleic acid and a second single strand break on a second strand of the target nucleic acid, thereby forming a double strand break in the target nucleic acid having a first overhang and a second overhang, wherein the first overhang and the second overhang undergo 3' exonuclease processing by a heterologous Trex2 molecule, wherein the double strand break is repaired by at least one DNA repair pathway, and wherein the sequence of the target nucleic acid after the repair comprises a deletion as compared to the sequence of the target nucleic acid prior to the repair, thereby modifying the sequence of the target region of the target nucleic acid in the mammalian cell.

In one embodiment, the step of generating a first single strand break and the second single strand break comprises contacting the cell with a first enzymatically active Cas9 (eaCas9) nickase molecule, a first gRNA molecule, a second gRNA molecule, and a second eaCas9 nickase molecule. In one embodiment, the first gRNA molecule and the first eaCas9 nickase molecule associate with the target nucleic acid and generate the first single strand break, and wherein the second gRNA molecule and the second eaCas9 nickase molecule associate with the target nucleic acid and generate the second single strand break.

In another aspect, disclosed herein is a method of modifying a sequence of a target nucleic acid in a cell, the method comprising contacting the cell with a first gRNA molecule, a first eaCas9 nickase molecule, a second gRNA molecule, a second eaCas9 nickase molecule, and a heterologous Trex2 molecule; wherein the first gRNA molecule and the first Cas9 nickase molecule associate with the target nucleic acid and generate a first single strand cleavage event on a first strand of the target nucleic acid; wherein the second gRNA molecule and the second Cas9 nickase molecule associate with the target nucleic acid and generate a second single strand cleavage event on a second strand of the target nucleic acid, thereby forming a double strand break in the target nucleic acid having a first overhang and a second overhang; wherein the first overhang and the second overhang undergo 3' exonuclease processing by the heterologous Trex2 molecule; and wherein the first overhang and the second overhang in the target nucleic acid are repaired by at least one DNA repair pathway, wherein the sequence of the target nucleic acid after the repair comprises a deletion as compared to the sequence of the target nucleic acid prior to the repair, thereby modifying the sequence of the target nucleic acid in the cell.

In another aspect, disclosed herein is a method of generating a precise deletion in a sequence of a target nucleic acid in a cell, the method comprising generating, within the cell, a first single strand break on a first strand of the target nucleic acid and a second single strand break on a second strand of the target nucleic acid, wherein the first single strand break is located at least 5 base pairs away from the second single strand break, thereby forming a double strand break in the target nucleic acid having a first 3' overhang and a second 3' overhang; and processing the double strand break in the target nucleic acid using a heterologous 3' Repair Exonuclease 2 (Trex2) molecule, thereby forming a processed double strand break; wherein the processed double strand break is repaired by at least one DNA repair pathway, and wherein the sequence of the target nucleic acid comprises a precise deletion after the repair as compared to the sequence of the target nucleic acid prior to the repair, thereby generating the precise deletion in the sequence of the target nucleic acid in the cell.

In another aspect, disclosed herein is a method of generating a precise deletion in a sequence of a target nucleic acid in a cell, the method comprising generating, within the cell, a first single strand break on a first strand of the target nucleic acid and a second single strand break on a second strand of the target nucleic acid, wherein the first single strand break is located at least 5 base pairs away from the second single strand break, thereby forming a double strand break in the target nucleic acid having a first 3' overhang and a second 3' overhang; and processing the double strand break in the target nucleic acid using a heterologous 3' Repair Exonuclease 2 (Trex2) molecule, thereby forming a processed double strand break; wherein the processed double strand break is repaired by at least one DNA repair pathway, and wherein the sequence of the target nucleic acid comprises a precise deletion after the repair as compared to the sequence of the target nucleic acid prior to the repair, thereby generating the precise deletion in the sequence of the target nucleic acid in the cell.

In one embodiment, the step of generating the first single strand break and the second single strand break comprises contacting the cell with a first gRNA molecule, a first enzymatically active Cas9 (eaCas9) nickase molecule, a second gRNA molecule, and a second eaCas9 nickase molecule. In one embodiment, the first gRNA molecule and the first eaCas9 nickase molecule associate with the target nucleic acid and generate the first single strand break, and wherein the second gRNA molecule and the second eaCas9 nickase molecule associate with the target nucleic acid and generate the second single strand break. In one embodiment, the step of processing the double strand break comprises contacting the cell with the heterologous Trex2 molecule.

In one embodiment, the deletion, e.g., the precise deletion, consists of the base pairs of the target nucleic acid that were located between the first single strand break and the second single strand break. In one embodiment, the deletion, e.g., the precise deletion, is 37, 47, or 61 base pairs in length. In one embodiment, the deletion, e.g., the precise deletion, is at least about 10, 15, 20, 30, 40, 50, 75, 100, 150, 200, 250, 300, 400, 500, 750, 1000, 2000, 3000, 4000, 5000, 6000, 7000, 8000, 9000, 10000, 50000, 100000, 250000, 500000, 750000, 1000000, 2000000, 3000000, 4000000, 5000000, 6000000, 7000000, 8000000, 9000000, or 10000000 base pairs in length.

In one embodiment, at least one of the first 3' overhang and the second 3' overhang is excised by the heterologous Trex2 molecule. In another embodiment, both of the first 3' overhang and the second 3' overhang is excised by the heterologous Trex2 molecules.

In one embodiment, the cell is a population of cells, and wherein the first overhang and the second overhang in the target nucleic acid are repaired by gene conversion in less than 10% of the cells in the population of cells.

In one embodiment, the cell is a population of cells, and wherein 20%-40% of cells in the population of cells comprise a deletion in the target nucleic acid after repair by the DNA repair pathway. In one embodiment, the cell is a population of cells, and wherein the first overhang and the second overhang in the target nucleic acid are repaired by alt-NHEJ in at least 20% to at least 40% of the cells in the population of cells.

In one embodiment, the cell is a population of cells, and wherein the frequency of the deletion in the target nucleic acid is increased at least two-fold in the population of cells that were contacted with the heterologous Trex2 molecule, as compared to the frequency of a deletion in the target nucleic acid after repair of a cleavage event in a population of cells that were not contacted with a heterologous Trex2 molecule.

In one embodiment, the cell is a population of cells, and wherein the deletion in the target nucleic acid is a precise deletion. In one embodiment, the precise deletion is about 37 base pairs in length. In another embodiment, the precise deletion is about 47 base pairs in length. In another embodiment, the precise deletion is about 61 base pairs in length.

In one embodiment, the cell is a population of cells, and wherein the sequence of the target nucleic acid after the repair comprises an insertion as compared to the sequence of the target nucleic acid prior to the repair in less than 20% of the population of cells. In another embodiment, the sequence of the target nucleic acid after the repair comprises an insertion as compared to the sequence of the target nucleic acid prior to the repair in less than 15%, 10%, or 5% of the population of cells In one embodiment, the heterologous Trex2 molecule comprises an amino acid sequence that is at least 85% identical to the amino acid sequence of SEQ ID NO:255. In one embodiment, the heterologous Trex2 molecule comprises a nucleic acid sequence that is at least 85% identical to the nucleic acid sequence of SEQ ID NO:256.

In one embodiment, the target nucleic acid is a promoter region of a gene, a coding region of a gene, a non-coding region of a gene, an intron of a gene, or an exon of a gene.

In one embodiment, the first eaCas9 nickase molecule and the second eaCas9 nickase molecule are the same species of eaCas9 nickase molecule. In one embodiment, the first eaCas9 nickase molecule and the second eaCas9 nickase molecule comprise HNH-like domain cleavage activity but have no N-terminal RuvC-like domain cleavage activity. In one embodiment, the first eaCas9 nickase molecule and the second eaCas9 nickase molecule are each an HNH-like domain nickase. In one embodiment, the first eaCas9 nickase molecule and the second eaCas9 nickase molecule each comprise a mutation at an amino acid position corresponding to amino acid position D10 of Streptococcus pyogenes Cas9. In one embodiment, the first overhang is a first 5' overhang, and wherein the second overhang is a second 5' overhang.

In one embodiment, the first eaCas9 nickase molecule and the second eaCas9 nickase molecule comprise N-terminal RuvC-like domain cleavage activity but have no HNH-like domain cleavage activity. In one embodiment, the first eaCas9 nickase molecule and the second eaCas9 nickase molecule are each an N-terminal RuvC-like domain nickase. In one embodiment, the first Cas9 molecule and the second Cas9 molecule each comprise an amino acid mutation at an amino acid position corresponding to amino acid position N863 of Streptococcus pyogenes Cas9.

In one embodiment, the cell is a human cell. In one embodiment, the cell is in, or from, a subject suffering from a disease or disorder. In one embodiment, the disease or disorder is a blood disease, an immune disease, a neurological disease, a cancer, an infectious disease, a genetic disease, a disorder caused by aberrant mtDNA, a metabolic disease, a disorder caused by aberrant cell cycle, a disorder caused by aberrant angiogenesis, a disorder caused by aberrant DNA damage repair, or a pain disorder. In one embodiment, the contacting is performed ex vivo. In one embodiment, the contacting is performed in vivo.

In one embodiment, the method further comprises sequencing the target nucleic acid, or portion of the target nucleic acid, prior to the contacting step and after the contacting step.

In one aspect, disclosed herein is a cell modified by the methods described herein.

In one aspect, disclosed herein is a pharmaceutical composition comprising a cell described herein.

In one aspect, disclosed herein is a composition, comprising a first non-naturally occurring gRNA molecule; a first non-naturally occurring eaCas9 nickase molecule; a second non-naturally occurring gRNA molecule; a second non-naturally occurring eaCas9 nickase molecule; and a Trex2 molecule; wherein the first gRNA molecule and the first eaCas9 nickase molecule are designed to associate with a target nucleic acid and generate a first single strand cleavage event on a first strand of the target nucleic acid; wherein the second gRNA molecule and the second eaCas9 nickase molecule are designed to associate with the target nucleic acid and generate a second single strand cleavage event on a second strand of the target nucleic acid, thereby forming a double strand break in the target nucleic acid having a first overhang and a second overhang; wherein the Trex2 molecule is designed to process the first overhang and second overhang; and wherein the first gRNA molecule, the first eaCas9 nickase molecule, the second gRNA molecule, the second eaCas9 nickase molecule, and the heterologous Trex2 molecule are designed such that the first overhang and the second overhang in the target nucleic acid are repaired by at least one DNA repair pathway.

In one embodiment, the at least one DNA repair pathway is alt-NHEJ. In one embodiment, the sequence of the target nucleic acid after the repair comprises a deletion as compared to the sequence of the target nucleic acid prior to the repair.

In one aspect, disclosed herein is a gene editing system comprising a first isolated gRNA molecule; a first isolated eaCas9 nickase molecule; a second isolated gRNA molecule; a second isolated eaCas9 nickase molecule; and an isolated Trex2 molecule; wherein the first gRNA molecule and the first eaCas9 nickase molecule are designed to associate with a target nucleic acid and generate a first single strand break on a first strand of the target nucleic acid; wherein the second gRNA molecule and the second eaCas9 nickase molecule are designed to associate with the target nucleic acid and generate a second single strand break on a second strand of the target nucleic acid, thereby forming a double strand break in the target nucleic acid having a first 3' overhang and a second 3' overhang; wherein the Trex2 molecule is designed to process the first 3' overhang and second 3' overhang, thereby forming a processed double strand break in the target nucleic acid; and wherein the first gRNA molecule, the first eaCas9 nickase molecule, the second gRNA molecule, the second eaCas9 nickase molecule, and the Trex2 molecule are designed such that the processed double strand break is repaired by at least one DNA repair pathway, producing a precise deletion in the target nucleic acid which consists of the base pairs of the target nucleic acid that were located between the first single strand break and the second single strand break. In one embodiment, the first eaCas9 nickase molecule and the second eaCas9 nickase molecule are the same species of eaCas9 nickase molecule.

In one embodiment, the Trex2 molecule comprises an amino acid sequence that is at least 85% identical to the amino acid sequence of SEQ ID NO:255. In one embodiment, the Trex2 molecule comprises a nucleic acid sequence that is at least 85% identical to the amino acid sequence of SEQ ID NO:256.

In one embodiment, the first eaCas9 nickase molecule and the second eaCas9 nickase molecule are the same species of eaCas9 nickase molecule. In one embodiment, the first eaCas9 nickase molecule and the second eaCas9 nickase molecule comprise HNH-like domain cleavage activity but have no N-terminal RuvC-like domain cleavage activity. In one embodiment, the first eaCas9 nickase molecule and the second eaCas9 nickase molecule are each an HNH-like domain nickase. In one embodiment, the first eaCas9 nickase molecule and the second eaCas9 nickase molecule each comprise a mutation at an amino acid position corresponding to amino acid position D10 of *Streptococcus pyogenes* Cas9. In one embodiment, the first overhang is a 5' overhang, and wherein the second overhang is a 5' overhang.

In one embodiment, the first eaCas9 nickase molecule and the second eaCas9 nickase molecule comprise N-terminal RuvC-like domain cleavage activity but have no HNH-like domain cleavage activity. In one embodiment, the first eaCas9 nickase molecule and the second eaCas9 nickase molecule are each an N-terminal RuvC-like domain nickase. In one embodiment, the first eaCas9 nickase molecule and the second eaCas9 nickase molecule each comprise an amino acid mutation at an amino acid position corresponding to amino acid position N863 of *Streptococcus pyogenes* Cas9.

In one embodiment, the first overhang is a 3' overhang, and wherein the second overhang is a 3' overhang.

In one embodiment, the first eaCas9 nickase molecule is a first eaCas9 polypeptide, wherein the second eaCas9 nickase molecule is a second eaCas9 polypeptide. In one embodiment, the first eaCas9 nickase molecule is a first nucleic acid encoding an eaCas9 polypeptide, and wherein the second eaCas9 nickase molecule is a second nucleic acid encoding an eaCas9 polypeptide.

In one embodiment, the Trex2 molecule is a Trex2 polypeptide or a nucleic acid encoding a Trex2 polypeptide.

In one embodiment, the first gRNA molecule and the first eaCas9 nickase molecule are a first pre-formed complex, and wherein the second gRNA molecule and the second eaCas9 nickase molecule are a second pre-formed complex.

In one embodiment, administration of the first pre-formed complex and the second pre-formed complex occur sequentially. In another embodiment, administration of the first pre-formed complex and the second pre-formed complex occur simultaneously.

BRIEF DESCRIPTION OF THE DRAWINGS

FIG. 10 is a model of the DNA end processing at N863A Cas9 nickase-induced double stranded breaks (DSBs) in the presence or absence of ectopic Trex2 expression. In the absence of ectopic Trex2 expression, processing of the 3' protruding arm occurs by ALT-NHEJ, leading predominantly to insertions, followed by deletions and HDR/gene conversion (GC) events (left box). In the presence of ectopic Trex2 expression (right box), NHEJ-mediated deletions are increased while both HDR/GC and insertions are strongly suppressed.

FIG. 13A is a schematic depicting the position of gRNAs 21, 19, and 8 on the HBB locus, alongside the length of the predicted overhang produced using a dual nickase cleavage strategy. PAM sequence location are shown in red. FIG. 13B depicts the overall modification frequency resolved for deletions, insertions, and gene conversion scored by Sanger sequencing of the amplified HBB locus in U2OS cells expressing the D10A-Cas9 nickase and gRNA pairs 8/19 and 8/21 in the presence (TREX2) or absence (CTRL) of ectopic 3'-5' exonuclease Trex2 expression.

FIG. 13C is a scatter dot plot overlaid with a box and whisker plot representing the deletions size scored from Sanger sequencing data of U2OS cells expressing the D10A-Cas9 nickase with gRNA pair 8/19 or gRNA pair 8/21 in the presence (TREX2) or absence (CTRL) of ectopic Trex2 expression. Each individual dot represents on Sanger sequenced read harboring a deletion.

FIG. 22A depicts the frequency of either deletion or insertion events at the HBB locus in U2OS cells nucleofected with plasmids encoding N863A Cas9, gRNA 8, and gRNA 15, in the presence or absence of nucleofection with a plasmid encoding Trex2. In the absence of ectopic expression of Trex2 the formation of long insertions and deletions of various lengths was observed at the HBB locus. In the presence of ectopic expression of Trex2, precise 47 nucleotide deletions were observed, as well as a decrease in the frequency of large insertions.

FIG. 22B depicts the frequency of either deletion or insertion events at the HBB locus in U2OS cells nucleofected with N863A Cas9 ribonuceloprotein complexes with gRNA 8 and gRNA 15, in the presence or absence of nucleofection with a plasmid encoding Trex2. In the absence of ectopic Trex2 expression, the formation of long insertions and deletions of various lengths was observed at the HBB locus. In the presence of ectopic Trex2 expression, precise 47 nucleotide deletions were observed, as well as a decrease in the frequency of large insertions.

DESCRIPTION

Definitions

Figure 1:
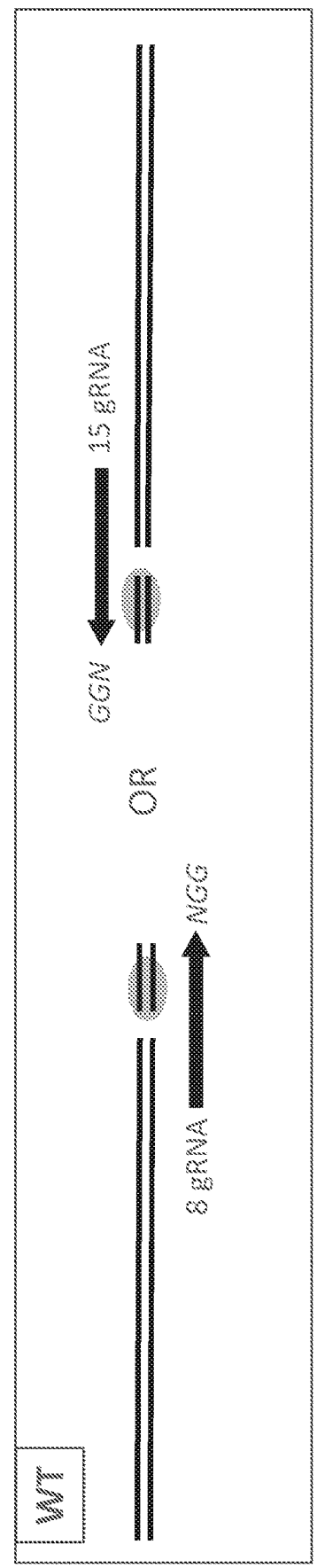
FIG. 1 depicts a schematic of gRNA 8 (left) and gRNA 15 (right) in combination with the wild-type (WT) Cas9 nuclease.

"Alter", "altered", or "altering", as the term is used herein, in reference to amino acid or nucleotide sequences, refers to a change in a sequence, e.g., a deletion of one or more amino acid residues or nucleotides, a mutation of one or more amino acid residues or nucleotides, or an insertion of one or more amino acid residues or nucleotides.

"Amino acids" as used herein encompasses the canonical amino acids as well as analogs thereof.

"Amino acid residues that flank a deletion", as that phrase is used herein, refers to the amino acid residue that immediately precedes the deletion and the amino acid residue that immediately follows the deletion. By way of example, in a sequence $_{CT}1$-$_{CT}2$-$_{CT}3$-$_{CT}7$-$_{CT}8$-$_{CT}9$, wherein $_{CT}4$-$_{CT}5$-$_{CT}6$ is deleted, the flanking amino acid residues are, $_{CT}3$ and $_{CT}7$.

"Cas9 polypeptide" refers to a molecule that is capable of interacting with a gRNA molecule and, in concert with the gRNA molecule, localize to a site comprising a target domain and, in certain embodiments, a PAM sequence. A Cas9 polypeptide may be a nuclease (an enzyme that cleaves both strands of a double-stranded nucleic acid), a nickase (an enzyme that cleaves one strand of a double-stranded nucleic acid), or an enzymatically inactive (or dead) Cas9 polypeptide. A Cas9 polypeptide having nuclease or nickase activity is referred to as an "enzymatically active Cas9" ("eaCas9"). A Cas9 polypeptide lacking the ability to cleave target nucleic acid is referred to as an "enzymatically inactive Cas9" (an "eiCas9"). Cas9 polypeptides include both naturally occurring Cas9 polypeptides and Cas9 polypeptides and engineered, altered, or modified Cas9 polypeptides, as well as Cas9 polypeptides that differ, e.g., by at least one amino acid residue, from a reference sequence, e.g., the most similar naturally occurring Cas9 polypeptide. Cas9 polypeptides also encompass biologically active fragments of full-length Cas9 polypeptides. The terms altered, engineered or modified, as used in this context, refer merely to a difference from a reference or naturally occurring sequence, and impose no specific process or origin limitations.

As used herein, the term "Cas9 molecule" encompasses both Cas9 polypeptides and nucleic acid molecules encoding Cas9 polypeptides.

In certain embodiments, a Cas9 molecule meets one or both of the following criteria:

it has at least 20, 30, 40, 50, 55, 60, 65, 70, 75, 80, 81, 82, 83, 84, 85, 86, 87, 88, 89, 90, 91, 92, 93, 94, 95, 96, 97, 98, 99, or 100% homology with, or it differs by no more than 1, 2, 3, 4, 5, 6, 7, 8, 9, 10, 11, 12, 13, 14, 15, 16, 17, 18, 19, 20, 25, 30, 35, 40, 35, 50, 55, 60, 65, 70, 75, 80, 85, 90, 95, 100, 150, 200, 250, 300, 350 or 400, amino acid residues from, the amino acid sequence of a reference sequences, e.g., naturally occurring Cas 9 molecule.

In certain embodiments, a Cas9 molecule meets one or both of the following criteria: it has at least 20, 30, 40, 50, 55, 60, 65, 70, 75, 80, 81, 82, 83, 84, 85, 86, 87, 88, 89, 90, 91, 92, 93, 94, 95, 96, 97, 98, 99, or 100% homology with, or it differs by no more than 1, 2, 3, 4, 5, 6, 7, 8, 9, 10, 11, 12, 13, 14, 15, 16, 17, 18, 19, 20, 25, 30, 35, 40, 35, 50, 55, 60, 65, 70, 75, 80, 85, 90, 95, 100, 150, 200, 250, 300, 350 or 400, amino acid residues from, the amino acid sequence of a reference sequences, e.g., naturally occurring Cas9 molecule.

In certain embodiments, except for a linker, a Cas9 molecule meets one or both of the following criteria: it has at least 20, 30, 40, 50, 55, 60, 65, 70, 75, 80, 81, 82, 83, 84, 85, 86, 87, 88, 89, 90, 91, 92, 93, 94, 95, 96, 97, 98, 99, or 100% homology with, or it differs by no more than 1, 2, 3, 4, 5, 6, 7, 8, 9, 10, 11, 12, 13, 14, 15, 16, 17, 18, 19, 20, 25, 30, 35, 40, 35, 50, 55, 60, 65, 70, 75, 80, 85, 90, 95, 100, 150, 200, 250, 300, 350 or 400, amino acid residues from, the amino acid sequence of a reference sequences, e.g., naturally-occurring Cas9 molecule. Homology except for a linker is determined as follows: a sequence having a linker is altered by omitting the linker sequence, and the thus altered sequence is compared with the reference sequence.

In certain embodiments, the Cas9 molecule is a *S. pyogenes* Cas9 variant. In certain embodiments, the Cas9 variant is the EQR variant. In certain embodiments, the Cas9 variant is the VRER variant. In certain embodiments, the eiCas9 molecule is a *S. pyogenes* Cas9 variant. In certain embodiments, the Cas9 variant is the EQR variant. In certain embodiments, the Cas9 variant is the VRER variant. In certain embodiments, a Cas9 system comprises a Cas9 molecule, e.g., a Cas9 molecule described herein, e.g., the Cas9 EQR variant or the Cas9 VRER variant.

In certain embodiments, the Cas9 molecule is a *S. aureus* Cas9 variant. In certain embodiments, the Cas9 variant is the KKH (E782K/N968K/R1015H) variant (see, e.g., Kleinstiver et al. (2015) NAT. BIOTECHNOL. 33(12):1293-8, the entire contents of which are expressly incorporated herein by reference). In certain embodiments, the Cas9 variant is the E782K/K929R/R1015H variant (see, e.g., Kleinstiver 2015). In certain embodiments, the Cas9 variant is the E782K/K929R/N968K/R1015H variant (see, e.g., Kleinstiver 2015). In certain embodiments the Cas9 variant comprises one or more mutations in one of the following residues: E782, K929, N968, R1015. In certain embodiments the Cas9 variant comprises one or more of the following mutations: E782K, K929R, N968K, R1015H and R1015Q (see, e.g., Kleinstiver 2015). In certain embodiments, a Cas9 system comprises a Cas9 molecule, e.g., a Cas9 molecule described herein, e.g., the Cas9 KKH variant.

As used herein, the term "nickase" molecule refers to a molecule which is capable of generating a single-strand DNA break (but not a double-strand break) at a specific location. A nickase may be an RNA-guided exonuclease, such as a Cas9, or another molecule that generates a single strand break at a position defined by the occurrence of a nucleic acid sequence. Examples of Cas9 nickases include nickases having N-terminal RuvC-like domain cleavage activity but no HNH-like domain cleavage activity. Cas9 nickases are described in more detail herein.

As used herein, the term "Cas9 system" or "gene editing system" refers to a system capable of altering a target nucleic acid by one of many DNA repair pathways. In certain embodiments, the Cas9 system described herein promotes repair of a target nucleic acid via an HDR pathway. In some embodiments, a Cas9 system comprises a gRNA and a Cas9 molecule. In some embodiments, a Cas9 system further comprises a second gRNA. In yet another embodiment, a Cas9 system comprises a gRNA, a Cas9 molecule, and a second gRNA. In some embodiments, a Cas9 system comprises a gRNA, two Cas9 molecules, and a second gRNA. In some embodiments, a Cas9 system comprises a first gRNA, a second gRNA, a first Cas9 molecule, and a second Cas9 molecule. In some embodiments, a Cas9 system further comprises a template nucleic acid.

In one embodiment, the gene editing system is a kit comprising each of the components. In another embodiment, the gene editing system is a composition. In one embodiment, the composition is part of a kit. In one embodiment, the kit further comprises instructions for modifying a target nucleic acid in a cell.

"Cleavage event", as used herein, is intended to include Cas9-mediated single-stranded and double-stranded DNA breaks. In an embodiment, the term "cleavage event" refers to one or more Cas9-mediated single-stranded DNA breaks. In an embodiment, the term "cleavage event" refers to one or more Cas9-mediated double-stranded DNA breaks. In an embodiment, the term "cleavage event" refers to a combination of one or more Cas9-mediated single-stranded DNA breaks, and one or more Cas9-mediated double-stranded DNA breaks.

"Contacting", as used herein in reference to a cell or a population of cells, is intended to include indirect or direct bringing together of a compound, e.g., a polypeptide or a nucleic acid, and a cell, or a population of cells. The term "contacting", as used herein, does not imply or require that the compound enter and/or traverse a membrane and/or cell wall of a cell, or a population of cells. However, in some embodiments, a compound may enter and/or traverse a membrane and/or cell wall of a cell, or a population of cells, after it is "contacted" with the compound. In some embodiments, the term "contacting" is intended to include in vitro exposure of a cell, or a population of cells, to a compound. In some embodiments, the term "contacting" is intended to include in vivo exposure of a cell, or a population of cells, to a compound. In some embodiments, the term "contacting" is intended to include ex vivo exposure of a cell, or a population of cells, to a compound. In some embodiments, the term "contacting" is intended to include exposure of a compound to a cell, or a population of cells via a carrier, e.g., a liposome or a viral particle. In some embodiments, the term "contacting" is intended to include exposure of a cell, or a population of cells, to a nucleic acid molecule, e.g., a DNA molecule, or a RNA molecule (e.g., a miRNA molecule or a gRNA molecule). In some embodiments, the term "contacting" is intended to include exposure of a cell, or a population of cells, to a polypeptide.

As used herein, the term "delete" or "deleting" refers to the removal of a segment of a nucleic acid sequence.

As used herein, the term "precise deletion" refers to the deletion of a segment of a nucleic acid resulting after repair by a DNA repair pathway with a precision of, for example, 5 nucleotides, 10 nucleotides, etc., from the position of a single strand break generated using a DNA nickase. The precise deletion can be defined in terms of a number of nucleotides or a base-pair distance, such as the distance between predicted nicks formed near first and second PAM sequences on first and second strands of a double stranded nucleic acid. As is discussed in greater detail below, and as illustrated in the figures, a precise deletion may also be defined in statistical terms within a population of cells as the modal (i.e., the most frequently observed) deletion length within a population as measured by sequencing cells following exposure to the gene editing systems described herein. For example, with reference to FIG. 7A, in the instance where a gene editing system is predicted to form first and second nicks separated by 47 base pairs (i.e., one in which a DSB is formed with 47 base overhangs), a precise deletion is described by the "Trex2" distribution in which the most commonly observed deletion species is 47 base pairs in length and a plurality of other common deletion species are within 3 or 4 nucleotides of that length. Alternatively or additionally, as illustrated by FIG. 9B, a precise deletion may be defined as one in which a plurality (e.g., a majority, or the most numerous species) of deletions occur within 10 base pairs of the predicted overhang length. In other instances, the precise deletion is one in which at least 10%, 15%, 20%, 25%, 30%, 35%, 40%, 45%, 50%, 55%, 60% or more of the deletions observed in the population occur within a defined range around the produced overhang length, e.g., 5, 6, 7, 8, 9, 10, 11, 12, 13, 14, 15, 16, 17, 18, 19 or 20 base pairs.

The term "precision", as used herein to describe the length and/or size of a nucleic acid deletion, refers to the exactness of the nucleotide deletion following a DNA lesion (e.g., a single stranded break or nick caused by a Cas9 nickase) and repair by a DNA repair pathway. For example, a deletion with a precision of 5 base pairs from a single stranded break includes a deletion with a boundary that commences from the single strand break location, as well as a deletion with a boundary within 5 base pairs of the single strand break location.

The term "mean" as described herein is a statistical measurement of central tendency or the average of a set of values and is calculated by adding a set of values and then dividing the sum by the number of values. A population of cells modified using the methods described herein may comprise a distribution of lengths of a deletion in a targeted nucleic acid having a mean length within 10, 9, 8, 7, 6, 5, 4, 3, 2, 1 or 0 base pairs of the number of base pairs between the first single strand break and the second single strand break.

The term "median" as described herein is a measure of the central tendency of a set of values and is determined by determining the middle value in an ordered set of values. A population of cells modified using the methods described herein may comprise a distribution of lengths of a deletion in a targeted nucleic acid having a median length within 10, 9, 8, 7, 6, 5, 4, 3, 2, 1 or 0 base pairs of the number of base pairs between the first single strand break and the second single strand break.

The term "median average distribution or MAD" as used herein represents the variance or dispersion of a population, and is calculated as the median of the absolute value of the difference between each element in the distribution (e.g., the length of a nucleic acid) and the distribution median. It is calculated as described in Leys et al. (2013) J. EXP. SOC. PSYCHOL. 49: 764-766, the entire contents of which are expressly incorporated by reference herein.

"Derived from", as used herein, refers to the source or origin of a molecular entity, e.g., a nucleic acid or protein. The source of a molecular entity may be naturally-occurring, recombinant, unpurified, or a purified molecular entity. For example, a polypeptide that is derived from a second polypeptide comprises an amino acid sequence that is identical or substantially similar, e.g., is more than 50% homologous to, the amino acid sequence of the second protein. The derived molecular entity, e.g., a nucleic acid or protein, can comprise one or more modifications, e.g., one or more amino acid or nucleotide changes.

"Domain," as used herein, is used to describe segments of a protein or nucleic acid. Unless otherwise indicated, a domain is not required to have any specific functional property.

As used herein, the term "double strand break" or DSB refers to two breaks in a nucleic acid molecule, e.g., a DNA molecule: a first break in a first strand of the nucleic acid molecule, and a second break in a second strand of the nucleic acid molecule. In one embodiment, a double strand break may have blunt ends. In another embodiment, a double strand break may have a first 3' overhang and a second 3' overhang. In yet another embodiment, a double strand break may have a first 5' overhang and a second 5' overhang.

As used herein, the term "endogenous" gene, "endogenous" nucleic acid, or "endogenous" homologous region refers to a native gene, nucleic acid, or region of a gene, which is in its natural location in the genome, e.g., chromosome or plasmid, of a cell. In contrast, the term "exogenous" gene or "exogenous" nucleic acid refers to a gene, nucleic acid, or region of a gene which is not native within a cell, but which is introduced into the cell during the methods disclosed herein. An exogenous gene or exogenous nucleic acid may be homologous to, or identical to, an endogenous gene or an endogenous nucleic acid. In one embodiment, the Trex2 molecule is an exogenous Trex2.

As used herein, "error-prone" repair refers to a DNA repair process that has a higher tendency to introduce mutations into the site being repaired. For instance, alt-NHEJ and SSA are error-prone pathways; C-NHEJ is also error prone because it sometimes leads to the creation of a small degree of alteration of the site (even though in some instances C-NHEJ results in error-free repair); and HR, alt-HR, and SSA in the case of a single-strand oligo donor are not error-prone.

As used herein, the term "exonuclease" refers to an enzyme which is capable of cleaving nucleotides one at the time from the end of a polynucleotide chain. In one embodiment, an exonuclease is a 3' to 5' exonuclease. 3' to 5' exonucleases include, for example, Trex2, polymerase δ, polymerase ε, polymerase γ, ExoN, p53, APE1/APE2, WRN, Dna2, MRE11/RAD50/NBS1, hRAD9, and EXDL2. In one embodiment, the 3' to 5' exonuclease is Trex2. In one embodiment, an exonuclease is not a 5' to 3' exonuclease. 5' to 3' exonulceases include, for example, FEN1, XPG/ERCC5, EXO1, FAN1, and EXOG. An "exonuclease molecule" comprises an exonuclease polypeptide or a nucleic acid encoding an exonuclease polypeptide.

As used herein, the term "gRNA molecule" or "gRNA" refers to a guide RNA which is capable of targeting a Cas9 molecule to a target nucleic acid. In one embodiment, the term "gRNA molecule" refers to a guide ribonucleic acid. In another embodiment, the term "gRNA molecule" refers to a nucleic acid encoding a gRNA. In one embodiment, a gRNA molecule is non-naturally occurring. In one embodiment, a gRNA molecule is a synthetic gRNA molecule.

"HDR", or homology-directed repair, as used herein, refers to the process of repairing DNA damage using a homologous nucleic acid (e.g., an endogenous nucleic acid, e.g., a sister chromatid, or an exogenous nucleic acid, e.g., a template nucleic acid). HDR typically occurs when there has been significant resection at a double-strand break, forming at least one single stranded portion of DNA. HDR is a category that includes, for example, single-strand annealing (SSA), homologous recombination (HR), single strand template repair (SST-R), and a third, not yet fully characterized alternative homologous recombination (alt-HR) DNA repair pathway. In some embodiments, HDR includes gene conversion and gene correction. In some embodiments, the term HDR does not encompass canonical NHEJ (C-NHEJ). In some embodiments, the term HDR does not encompass alternative non-homologous end joining (Alt-NHEJ) (e.g., blunt end-joining (blunt EJ), (micro homology mediated end joining (MMEJ), and synthesis dependent microhomology-mediated end joining (SD-MMEJ)).

"PI domain", as that term is used herein, refers to the region of a Cas9 molecule that interacts with the PAM sequence of a target nucleic acid.

The terms "homology" or "identity," as used interchangeably herein, refer to sequence identity between two amino acid sequences or two nucleic acid sequences, with identity being a more strict comparison. The phrases "percent identity or homology" and "% identity or homology" refer to the percentage of sequence identity found in a comparison of two or more amino acid sequences or nucleic acid sequences. Two or more sequences can be anywhere from 0-100% identical, or any value there between. Identity can be determined by comparing a position in each sequence that can be aligned for purposes of comparison to a reference sequence. When a position in the compared sequence is occupied by the same nucleotide base or amino acid, then the molecules are identical at that position. A degree of identity of amino acid sequences is a function of the number of identical amino acids at positions shared by the amino acid sequences. A degree of identity between nucleic acid sequences is a function of the number of identical or matching nucleotides at positions shared by the nucleic acid sequences. A degree of homology of amino acid sequences is a function of the number of amino acids at positions shared by the polypeptide sequences.

Calculations of homology or sequence identity between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frame shift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences.

As used herein, the terms "heterologous", e.g., "heterologous protein", "heterologous polypeptide", "heterologous gene", "heterologous nucleic acid," etc., as used herein, refers to a molecule, e.g., a gene, nucleic acid, or polypeptide, or a fragment or domain thereof, that is not normally found in a given cell in nature. In some embodiments, the heterologous protein or heterologous nucleic acid is exogenously introduced into a given cell. A "heterologous nucleic acid" includes a gene, or fragment thereof, that is homologous or identical to a native gene, but which has been introduced into the host cell in a form that is different from the corresponding native gene. For example, a heterologous nucleic acid may include a native gene coding sequence that is engineered as a chimeric gene to include a native coding sequence and non-native regulatory regions, which may then be introduced into a host cell. A heterologous gene may also include a native gene, or fragment thereof, introduced into a non-native host cell. Thus, a heterologous gene may be foreign or native to the recipient cell; a nucleic acid sequence that is naturally found in a given cell but expresses an unnatural amount of the nucleic acid and/or the polypeptide which it encodes; and/or two or more nucleic acid sequences that are not found in the same relationship to each other in nature, e.g., a native nucleic acid sequence operably-linked to a non-native regulatory nucleic acid sequence.

The term "isolated protein" or "isolated polypeptide" is a protein or polypeptide that by virtue of its origin or source of derivation is not associated with naturally associated components that accompany it in its native state; is substantially free of other proteins from the same species; is expressed by a cell from a different species; or does not occur in nature. Thus, a polypeptide that is chemically synthesized or synthesized in a cellular system different from the cell from which it naturally originates will be "isolated" from its naturally associated components. A protein may also be rendered substantially free of naturally associated components by isolation, using protein purification techniques well known in the art.

Similarly, the term "isolated gene" or "isolated nucleic acid" is a gene or nucleic acid that by virtue of its origin or source of derivation is not associated with naturally associated components that accompany it in its native state; is substantially free of other proteins from the same species; is expressed by a cell from a different species; or does not occur in nature. Thus, a nucleic acid that is chemically synthesized or synthesized in a cellular system different from the cell from which it naturally originates will be "isolated" from its naturally associated components. A nucleic acid may also be rendered substantially free of naturally associated components by isolation, using protein purification techniques well known in the art.

A disorder "caused by" a mutation, as used herein, refers to a disorder that is made more likely or severe by the presence of the mutation, compared to a subject that does not have the mutation. The mutation need not be the only cause of a disorder, i.e., the disorder can still be caused by the mutation even if other causes, such as environmental factors or lifestyle factors, contribute causally to the disorder. In an embodiment, the disorder is caused by the mutation if the mutation is a medically recognized risk factor for developing the disorder, and/or if a study has found that the mutation correlates with development of the disorder.

"Canonical HDR", or canonical homology-directed repair, as used herein, refers to the process of repairing DNA damage using a homologous nucleic acid (e.g., a sister chromatid or an exogenous nucleic acid, e.g., a template nucleic acid). Canonical HDR typically acts when there has been significant resection at the double strand break, forming at least one single stranded portion of DNA. In a normal cell, HDR typically involves a series of steps such as recognition of the break, stabilization of the break, resection, stabilization of single stranded DNA, formation of a DNA crossover intermediate, resolution of the crossover intermediate, and ligation. The process requires RAD51 and BRCA2, and the homologous nucleic acid is typically double-stranded.

"Homologous recombination" or "HR" refers to a type of HDR DNA-repair which typically acts occurs when there has been significant resection at the double-strand break, forming at least one single stranded portion of DNA. In a normal cell, HR typically involves a series of steps such as recognition of the break, stabilization of the break, resection, stabilization of single stranded DNA, formation of a DNA crossover intermediate, resolution of the crossover intermediate, and ligation. The process requires RAD51 and BRCA2, and the homologous nucleic acid is typically double-stranded. In some embodiments, homologous recombination includes gene conversion.

"Gene conversion", as used herein, refers to the process of repairing DNA damage by homology directed recombination using an endogenous nucleic acid, e.g., a sister chromatid, as a template nucleic acid. Without being bound by theory, in some embodiments, BRCA1, BRCA2 and/or RAD51 are believed to be involved in gene conversion. In some embodiments, the endogenous nucleic acid is a nucleic acid sequence having significant homology with a fragment of DNA proximal to the site of the DNA lesion. In some embodiments, the template is not an exogenous nucleic acid.

"Gene correction", as used herein, refers to the process of repairing DNA damage by homology directed recombination using an exogenous nucleic acid, e.g., a donor template nucleic acid. In some embodiments, the exogenous nucleic acid is single-stranded. In some embodiments, the exogenous nucleic acid is double-stranded.

"ALT-HDR", or "alternative HDR", or "alternative homology-directed repair", as used herein, refers to the process of repairing DNA damage using a homologous nucleic acid (e.g., a sister chromatid or an exogenous nucleic acid, e.g., a template nucleic acid). ALT-HDR is distinct from canonical HDR in that the process utilizes different pathways from canonical HDR, and can be inhibited by the canonical HDR mediators, RAD51 and BRCA2. Also, ALT-HDR uses a single-stranded or nicked homologous nucleic acid for repair of the break.

"Canonical NHEJ", or canonical Non-homologous end joining, as used herein, refers to the process of repairing double strand breaks in which the break ends are directly ligated. This process does not require a homologous nucleic acid to guide the repair, and can result in the deletion or insertion of one or more nucleotides. This process requires the Ku heterodimer (Ku70/Ku80), the catalytic subunit of DNA-PK (DN-PKcs), and DNA ligase XRCC4/LIG4. Unless indicated otherwise, the term "HDR" as used herein encompasses canonical HDR and alt-HDR.

"ALT-NHEJ" or "alternative NHEJ", or alternative non-homologous end joining, as used herein, is a type of alternative end joining repair process, and utilizes a different pathway from that of canonical NHEJ. In alternative NHEJ, a small degree of resection occurs at the break ends on both sides of the break to reveal single-stranded overhangs. Ligation or annealing of the overhangs results in the deletion of sequence. microhomology-mediated end joining (MMEJ) is a type of ALT-NHEJ. In MMEJ, microhomologies, or short spans of homologous sequences, e.g., 5 nucleotides or more, on the single-strand are aligned to guide repair, and leads to the deletion of sequence between the microhomologies.

"Single strand annealing" or "SSA", as used herein, refers to the DNA repair process which involves annealing at two repeated sequences oriented in the same direction, e.g., direct repeats, with one repeat on either side of the break. This process results in the deletion of the sequence between the repeats of the target sequence. SSA is believed to be a sub-branch of HR. As with canonical HDR, a cell typically uses SSA when there has been significant resection at the break. Thus, SSA is characterized by having a longer length of resection (longer than Alt-NHEJ) and a longer stretch of homology at the double stranded break ("DSB") site (>30 bp).

As used herein, the term "mutation" refers to a change in the sequence of a nucleic acid, resulting a variant form of the nucleic acid. A mutation in a nucleic acid may be caused by the alteration of a single base pair in the nucleic acid, or the insertion, deletion, or rearrangement of larger sections of the nucleic acid. A mutation in a gene may result in variants of the protein encoded by the gene which are associated with genetic disorders. For example, a mutation (e.g., GAG→GTG) results in the substitution of valine for glutamic acid at amino acid position 6 in exon 1 of the HBB gene. This mutation in the HBB gene is associated with beta thalassemia and sickle cell disease.

As used herein, the term "off-target mutagenesis" refers to a change in the sequence of a nucleic acid which is not the target nucleic acid for the gene editing system disclosed herein.

As used herein, the term "overhang" refers to a stretch of unpaired nucleotides on the end of a nucleic acid molecule, e.g., a DNA molecule. The unpaired nucleotides can be on either the first strand of the DNA or the second strand of the DNA, creating either a 3' overhang or a 5' overhang.

The terms "paired nickases" or "paired nickase system" are used in this disclosure to refer to any system that utilizes two nickases targeted to two distinct nucleotide sequences (for instance, by means of two gRNAs) to form two single strand breaks on opposite DNA strands (e.g., sense and antisense, top and bottom, first and second, etc.). The single-strand breaks formed by a paired nickase system are generally capable of forming a DSB that includes one or more overhangs, though a paired nickase system may, in some cases, form single strand breaks that do not result in a double strand break. Each nickase in a "paired nickase" system may be of the same species of nickase. For example, "paired nickases" may comprise a first N863A nickase and a second N863A nickase, each of which binds to a different gRNA molecule and associates with two distinct nucleotide sequences to form two single strand breaks on opposite DNA strands.

"Polypeptide", as used herein, refers to a polymer of amino acids.

As used herein, the term "processing," with respect to overhangs, refers to either the endonucleolytic processing or the exonucleolytic processing of a break in a nucleic acid molecule. In one embodiment, the processing is exonucleolytic processing. In one embodiment, processing of a 3' overhang in a nucleic acid molecule may result in the entire overhang being removed, resulting in a blunt end. In another embodiment, processing of a 3' overhang in a nucleic acid molecule may result in more than the overhang being removed, resulting in a 5' overhang. In another embodiment, processing of a 3' overhang in a nucleic acid molecule may be incomplete, resulting in less than the whole overhang being removed, resulting in a shorter 3' overhang as compared to the original 3' overhang.

As used herein, the term "processed double strand break" refers to a double strand break which has undergone exonucleolytic processing, e.g., exonucleolytic processing by a Trex2 molecule. In one embodiment, a processed double strand break has blunt ends. In another embodiment, a processed double strand break comprises a first 3' overhang and a second 3' overhang. In yet another embodiment, a processed double strand break comprises a first 5' overhang and a second 5' overhang.

A "reference molecule", as used herein, refers to a molecule to which a modified or candidate molecule is compared. For example, a reference Cas9 molecule refers to a Cas9 molecule to which a modified or Cas9 molecule is compared. The modified or candidate molecule may be compared to the reference molecule on the basis of sequence (e.g., the modified or candidate may have X % sequence identity or homology with the reference molecule) or activity (e.g., the modified or candidate molecule may have X % of the activity of the reference molecule). For example, where the reference molecule is a Cas9 molecule, a modified or candidate may be characterized as having no more than 10% of the nuclease activity of the reference Cas9 molecule. Examples of reference Cas9 molecules include naturally occurring unmodified Cas9 molecules, e.g., a naturally occurring Cas9 molecule from *S. pyogenes, S. aureus, S. thermophilus* or *N. meningitidis*. In certain embodiments, the reference Cas9 molecule is the naturally occurring Cas9 molecule having the closest sequence identity or homology with the modified or candidate Cas9 molecule to which it is being compared. In certain embodiments, the reference Cas9 molecule is a parental molecule having a naturally occurring or known sequence on which a mutation has been made to arrive at the modified or candidate Cas9 molecule.

"Replacement", or "replaced", as used herein with reference to a modification of a molecule does not require a process limitation but merely indicates that the replacement entity is present.

"Resection", as used herein, refers to exonuclease-mediated digestion of one strand of a double-stranded DNA molecule, which results in a single-stranded overhang. Resection may occur, e.g., on one or both sides of a double-stranded break. Resection, can be measured by, for instance, extracting genomic DNA, digesting it with an enzyme that selectively degrades dsDNA, and performing quantitative PCR using primers spanning the DSB site.

"Subject", as used herein, may mean either a human or non-human animal. The term includes, but is not limited to, mammals (e.g., humans, other primates, pigs, rodents (e.g., mice and rats or hamsters), rabbits, guinea pigs, cows, horses, cats, dogs, sheep, and goats). In an embodiment, the subject is a human, and in certain of these embodiments, the human is an infant, child, young adult, or adult. In another embodiment, the subject is poultry.

"Treat", "treating", and "treatment", as used herein, mean the treatment of a disease in a mammal, e.g., in a human, including (a) inhibiting the disease, i.e., arresting or preventing its development; (b) relieving the disease, i.e., causing regression of the disease state; (c) relieving one or more symptoms of the disease; and (d) curing the disease.

"Prevent," "preventing" and "prevention," as used herein, means the prevention of a disease in a subject, e.g., a mammal, e.g., in a human, including (a) avoiding or precluding the disease; (b) affecting the predisposition toward the disease, and (c) preventing or delaying the onset of at least one symptom of the disease.

As used herein, the term "target nucleic acid" or "target gene" refers to a nucleic acid which is being targeted for alteration, e.g., generation of a precise deletion, by a Cas9 system described herein. In certain embodiments, a target nucleic acid comprises one gene. In certain embodiments, a target nucleic acid may comprise one or more genes, e.g., two genes, three genes, four genes, or five genes. In one embodiment, a target nucleic acid comprises two strands: a first strand and a second strand.

"Target position" as used herein, refers to a site on a target nucleic acid (e.g., the chromosome) that is modified by a Cas9 molecule-dependent process. For example, the target position can be modified by a Cas9 molecule-mediated cleavage of the target nucleic acid and template nucleic acid directed modification, e.g., correction, of the target position. In an embodiment, a target position can be a site between two nucleotides, e.g., adjacent nucleotides, on the nucleic acid into which one or more nucleotides is added. The target position may comprise one or more nucleotides that are altered, e.g., corrected, by a template nucleic acid. In an embodiment, the target position is within a "target sequence" (e.g., the sequence to which the gRNA binds). In an embodiment, a target position is upstream or downstream of a target sequence (e.g., the sequence to which the gRNA binds).

"Target position region," as used herein, is a region that comprises a target position and at least one nucleotide position outside the target position. In certain embodiments, the target position is flanked by sequences of the target position region, i.e., the target position is disposed in the target position region such that there are target position region sequences both 5' and 3' to the target position. In certain embodiments, the target position region provides sufficient sequences on each side (i.e., 5' and 3') of the target position to allow gene conversion of the target position, wherein the gene conversion uses an endogenous sequence homologous with the target position region as a template.

"Target sequence" as used herein refers to a nucleic acid sequence comprising a target position of a target gene. In some embodiments, the target gene is an HBB gene. The "targeting domain" of the gRNA is complementary to the "target sequence" on the target nucleic acid.

The "targeting domain" of the gRNA is complementary to the "target domain" on the target nucleic acid.

A "template nucleic acid", as that term is used herein, refers to a nucleic acid sequence which can be used in conjunction with a Cas9 molecule and a gRNA molecule to alter the structure of a target position. "Template nucleic acid" is used interchangeably with "donor template", "donor nucleic acid" and "swap nucleic acid" herein. In an embodiment, the target nucleic acid is modified to have the some or all of the sequence of the template nucleic acid, typically at or near cleavage site(s). In an embodiment, the template nucleic acid is single stranded. In an alternate embodiment, the template nucleic acid is double stranded. In an embodiment, the template nucleic acid is DNA, e.g., double stranded DNA. In an alternate embodiment, the template nucleic acid is single stranded DNA or nicked DNA. In an embodiment, the template nucleic acid is RNA, e.g., double stranded RNA or single stranded RNA. In an embodiment, the template nucleic acid is encoded on the same vector backbone, e.g. AAV genome, plasmid DNA, as the Cas9 and gRNA. In an embodiment, the template nucleic acid is excised from a vector backbone in vivo, e.g., it is flanked by gRNA recognition sequences. In one embodiment, the template DNA is in an ILDV. In one embodiment, the template nucleic acid is an exogenous nucleic acid sequence. In another embodiment, the template nucleic acid sequence is an endogenous nucleic acid sequence. In one embodiment, the template nucleic acid is a single stranded oligonucleotide corresponding to a plus strand of a nucleic acid sequence. In another embodiment, the template nucleic acid is a single stranded oligonucleotide corresponding to a minus strand of a nucleic acid sequence.

"Trex2 molecule", as that term is used herein, refers to a "Trex2 polypeptide" or a "Trex2 nucleic acid." A "Trex2 polypeptide" refers to a polypeptide which has 3' exonuclease activity. For example, a Trex2 polypeptide may have at least 80% identity to a Trex2 polypeptide disclosed herein, e.g., SEQ ID NO: 255, or a fragment thereof having exonuclease activity. In one embodiment, the exonuclease activity is 3' to 5' exonuclease activity. In some embodiments, the term "Trex2 nucleic acid", as used herein, refers to a nucleic acid, e.g., a DNA molecule or a RNA molecule (e.g., a mRNA molecule) encoding a Trex2 polypeptide. In one embodiment, the Trex2 nucleic acid has at least 80% identity to a Trex2 nucleic acid disclosed herein, e.g., SEQ ID NO:256. In some embodiments, the Trex2 molecule is a eukaryotic homolog or ortholog of a Trex2 molecule disclosed herein, e.g., SEQ ID NO: 255 or SEQ ID NO: 256. In some embodiments, the Trex2 molecule is a mammalian homolog or ortholog of a Trex2 molecule disclosed herein. In some embodiments, the Trex2 molecule is a non-human homolog or ortholog of a Trex2 molecule disclosed herein. In some embodiments, the Trex2 molecule is derived from a bacteria, a yeast, a plant, an insect, a mammal, a rodent, a non-human primate, or a human. In one embodiment, a Trex2 molecule is an isolated Trex2 molecule. In another embodiment, a Trex2 molecule is a heterologous Trex2 molecule.

"Wild type", as used herein, refers to a gene or polypeptide which has the characteristics, e.g., the nucleotide or amino acid sequence, of a gene or polypeptide from a naturally-occurring source. The term "wild type" typically includes the most frequent observation of a particular gene or polypeptide in a population of organisms found in nature.

"X" as used herein in the context of an amino acid sequence, refers to any amino acid (e.g., any of the twenty natural amino acids) unless otherwise specified.

Guide RNA (gRNA) Molecules

A gRNA molecule, as that term is used herein, refers to a nucleic acid that promotes the specific targeting or homing of a gRNA molecule/Cas9 molecule complex to a target nucleic acid. gRNA molecules can be unimolecular (having a single RNA molecule) (e.g., chimeric), or modular (comprising more than one, and typically two, separate RNA molecules). Additional details on gRNAs are provided in Section I entitled "gRNA molecules" of International Application PCT/US2014/057905, and this application is herein incorporated by reference in its entirety.

The gRNA comprises a targeting domain comprising, consisting of, or consisting essentially of a nucleic acid sequence fully or partially complementary to a target domain. In certain embodiments, the gRNA molecule further comprises one or more additional domains, including for example a first complementarity domain, a linking domain, a second complementarity domain, a proximal domain, a tail domain, and a 5' extension domain. Each of these domains is discussed in detail below. In certain embodiments, one or more of the domains in the gRNA molecule comprises an amino acid sequence identical to or sharing sequence homology with a naturally occurring sequence, e.g., from S. pyogenes, S. aureus, or S. thermophilus.

In certain embodiments, a unimolecular, or chimeric, gRNA comprises, preferably from 5' to 3': a targeting domain complementary to a target domain in a nucleotide in a cell such as a chromosome; a first complementarity domain; a linking domain; a second complementarity domain (which is complementary to the first complementarity domain); a proximal domain; and optionally, a tail domain.

In certain embodiments, a modular gRNA comprises: a first strand comprising, preferably from 5' to 3': a targeting domain complementary to a target domain in a nucleotide in a cell such as a chromosome; and a first complementarity domain; and a second strand, comprising, preferably from 5' to 3': optionally, a 5' extension domain; a second complementarity domain; a proximal domain; and optionally, a tail domain.

Targeting Domain

The targeting domain (sometimes referred to alternatively as the guide sequence or complementarity region) comprises, consists of, or consists essentially of a nucleic acid sequence that is complementary or partially complementary to a target nucleic acid sequence.

Methods for selecting targeting domains are known in the art (see, e.g., Fu et al. (2014) NAT. BIOTECHNOL. 32(3): 279-84; Sternberg et al. (2014) NATURE 507(7490):62-67, the entire contents of each of which are expressly incorporated by reference herein).

The strand of the target nucleic acid comprising the target domain is referred to herein as the complementary strand because it is complementary to the targeting domain sequence. Since the targeting domain is part of a gRNA molecule, it comprises the base uracil (U) rather than thymine (T); conversely, any DNA molecule encoding the gRNA molecule will comprise thymine rather than uracil. In a targeting domain/target domain pair, the uracil bases in the targeting domain will pair with the adenine bases in the target domain. In certain embodiments, the degree of complementarity between the targeting domain and target domain is sufficient to allow targeting of a Cas9 molecule to the target nucleic acid.

In certain embodiments, the targeting domain comprises a core domain and an optional secondary domain. In certain of these embodiments, the core domain is located 3' to the secondary domain, and in certain of these embodiments the core domain is located at or near the 3' end of the targeting domain. In certain of these embodiments, the core domain consists of or consists essentially of about 8 to about 13 nucleotides at the 3' end of the targeting domain. In certain embodiments, only the core domain is complementary or partially complementary to the corresponding portion of the target domain, and in certain of these embodiments the core domain is fully complementary to the corresponding portion of the target domain. In other embodiments, the secondary domain is also complementary or partially complementary to a portion of the target domain. In certain embodiments, the core domain is complementary or partially complementary to a core domain target in the target domain, while the secondary domain is complementary or partially complementary to a secondary domain target in the target domain. In certain embodiments, the core domain and secondary domain have the same degree of complementarity with their respective corresponding portions of the target domain. In other embodiments, the degree of complementarity between the core domain and its target and the degree of complementarity between the secondary domain and its target may differ. In certain of these embodiments, the core domain may have a higher degree of complementarity for its target than the secondary domain, whereas in other embodiments the secondary domain may have a higher degree of complementarity than the core domain.

In certain embodiments, the targeting domain and/or the core domain within the targeting domain is 3 to 100, 5 to 100, 10 to 100, or 20 to 100 nucleotides in length, and in certain of these embodiments the targeting domain or core domain is 3 to 15, 3 to 20, 5 to 20, 10 to 20, 15 to 20, 5 to 50, 10 to 50, or 20 to 50 nucleotides in length. In certain embodiments, the targeting domain and/or the core domain within the targeting domain is 6, 7, 8, 9, 10, 11, 12, 13, 14, 15, 16, 17, 18, 19, 20, 21, 22, 23, 24, 25, or 26 nucleotides in length. In certain embodiments, the targeting domain and/or the core domain within the targeting domain is 6+/−2, 7+/−2, 8+/−2, 9+/−2, 10+/−2, 10+/−4, 10+/−5, 11+/−2, 12+/−2, 13+/−2, 14+/−2, 15+/−2, or 16+−2, 20+/−5, 30+/−5, 40+/−5, 50+/−5, 60+/−5, 70+/−5, 80+/−5, 90+/−5, or 100+/−5 nucleotides in length.

In certain embodiments wherein the targeting domain includes a core domain, the core domain is 3 to 20 nucleotides in length, and in certain of these embodiments the core domain 5 to 15 or 8 to 13 nucleotides in length. In certain embodiments wherein the targeting domain includes a secondary domain, the secondary domain is 0, 1, 2, 3, 4, 5, 6, 7, 8, 9, 10, 11, 12, 13, 14 or 15 nucleotides in length. In certain embodiments wherein the targeting domain comprises a core domain that is 8 to 13 nucleotides in length, the targeting domain is 26, 25, 24, 23, 22, 21, 20, 19, 18, 17, or 16 nucleotides in length, and the secondary domain is 13 to 18, 12 to 17, 11 to 16, 10 to 15, 9 to 14, 8 to 13, 7 to 12, 6 to 11, 5 to 10, 4 to 9, or 3 to 8 nucleotides in length, respectively.

In certain embodiments, the targeting domain is fully complementary to the target domain. Likewise, where the targeting domain comprises a core domain and/or a secondary domain, in certain embodiments one or both of the core domain and the secondary domain are fully complementary to the corresponding portions of the target domain. In other embodiments, the targeting domain is partially complementary to the target domain, and in certain of these embodiments where the targeting domain comprises a core domain and/or a secondary domain, one or both of the core domain and the secondary domain are partially complementary to the corresponding portions of the target domain. In certain of these embodiments, the nucleic acid sequence of the targeting domain, or the core domain or targeting domain within the targeting domain, is at least 80, 85, 90, or 95% complementary to the target domain or to the corresponding portion of the target domain. In certain embodiments, the targeting domain and/or the core or secondary domains within the targeting domain include one or more nucleotides that are not complementary with the target domain or a portion thereof, and in certain of these embodiments the targeting domain and/or the core or secondary domains within the targeting domain include 1, 2, 3, 4, 5, 6, 7, or 8 nucleotides that are not complementary with the target domain. In certain embodiments, the core domain includes 1, 2, 3, 4, or 5 nucleotides that are not complementary with the corresponding portion of the target domain. In certain embodiments wherein the targeting domain includes one or more nucleotides that are not complementary with the target domain, one or more of said non-complementary nucleotides are located within five nucleotides of the 5' or 3' end of the targeting domain. In certain of these embodiments, the targeting domain includes 1, 2, 3, 4, or 5 nucleotides within five nucleotides of its 5' end, 3' end, or both its 5' and 3' ends that are not complementary to the target domain. In certain embodiments wherein the targeting domain includes two or more nucleotides that are not complementary to the target domain, two or more of said non-complementary nucleotides are adjacent to one another, and in certain of these embodiments the two or more consecutive non-complementary nucleotides are located within five nucleotides of the 5' or 3' end of the targeting domain. In other embodiments, the two or more consecutive non-complementary nucleotides are both located more than five nucleotides from the 5' and 3' ends of the targeting domain.

In certain embodiments, the targeting domain, core domain, and/or secondary domain do not comprise any modifications. In other embodiments, the targeting domain, core domain, and/or secondary domain, or one or more nucleotides therein, have a modification, including but not limited to the modifications set forth below. In certain embodiments, one or more nucleotides of the targeting domain, core domain, and/or secondary domain may comprise a 2' modification (e.g., a modification at the 2' position on ribose), e.g., a 2-acetylation, e.g., a 2' methylation. In certain embodiments, the backbone of the targeting domain can be modified with a phosphorothioate. In certain embodiments, modifications to one or more nucleotides of the targeting domain, core domain, and/or secondary domain render the targeting domain and/or the gRNA comprising the targeting domain less susceptible to degradation or more bio-compatible, e.g., less immunogenic. In certain embodiments, the targeting domain and/or the core or secondary domains include 1, 2, 3, 4, 5, 6, 7, or 8 or more modifications, and in certain of these embodiments the targeting domain and/or core or secondary domains include 1, 2, 3, or 4 modifications within five nucleotides of their respective 5' ends and/or 1, 2, 3, or 4 modifications within five nucleotides of their respective 3' ends. In certain embodiments, the targeting domain and/or the core or secondary domains comprise modifications at two or more consecutive nucleotides.

In certain embodiments wherein the targeting domain includes core and secondary domains, the core and secondary domains contain the same number of modifications. In certain of these embodiments, both domains are free of modifications. In other embodiments, the core domain includes more modifications than the secondary domain, or vice versa.

In certain embodiments, modifications to one or more nucleotides in the targeting domain, including in the core or secondary domains, are selected to not interfere with targeting efficacy, which can be evaluated by testing a candidate modification using a system as set forth below. gRNAs having a candidate targeting domain having a selected length, sequence, degree of complementarity, or degree of modification can be evaluated using a system as set forth below. The candidate targeting domain can be placed, either alone or with one or more other candidate changes in a gRNA molecule/Cas9 molecule system known to be functional with a selected target, and evaluated.

In certain embodiments, all of the modified nucleotides are complementary to and capable of hybridizing to corresponding nucleotides present in the target domain. In another embodiment, 1, 2, 3, 4, 5, 6, 7 or 8 or more modified nucleotides are not complementary to or capable of hybridizing to corresponding nucleotides present in the target domain.

First and Second Complementarity Domains

The first and second complementarity (sometimes referred to alternatively as the crRNA-derived hairpin sequence and tracrRNA-derived hairpin sequences, respectively) domains are fully or partially complementary to one another. In certain embodiments, the degree of complementarity is sufficient for the two domains to form a duplexed region under at least some physiological conditions. In certain embodiments, the degree of complementarity between the first and second complementarity domains, together with other properties of the gRNA, is sufficient to allow targeting of a Cas9 molecule to a target nucleic acid.

In certain embodiments, the first and/or second complementarity domain includes one or more nucleotides that lack complementarity with the corresponding complementarity domain. In certain embodiments, the first and/or second complementarity domain includes 1, 2, 3, 4, 5, or 6 nucleotides that do not complement with the corresponding complementarity domain. For example, the second complementarity domain may contain 1, 2, 3, 4, 5, or 6 nucleotides that do not pair with corresponding nucleotides in the first complementarity domain. In certain embodiments, the nucleotides on the first or second complementarity domain that do not complement with the corresponding complementarity domain loop out from the duplex formed between the first and second complementarity domains. In certain of these embodiments, the unpaired loop-out is located on the second complementarity domain, and in certain of these embodiments the unpaired region begins 1, 2, 3, 4, 5, or 6 nucleotides from the 5' end of the second complementarity domain.

In certain embodiments, the first complementarity domain is 5 to 30, 5 to 25, 7 to 25, 5 to 24, 5 to 23, 7 to 22, 5 to 22, 5 to 21, 5 to 20, 7 to 18, 7 to 15, 9 to 16, or 10 to 14 nucleotides in length, and in certain of these embodiments the first complementarity domain is 5, 6, 7, 8, 9, 10, 11, 12, 13, 14, 15, 16, 17, 18, 19, 20, 21, 22, 23, 24, or 25 nucleotides in length. In certain embodiments, the second complementarity domain is 5 to 27, 7 to 27, 7 to 25, 5 to 24, 5 to 23, 5 to 22, 5 to 21, 7 to 20, 5 to 20, 7 to 18, 7 to 17, 9 to 16, or 10 to 14 nucleotides in length, and in certain of these embodiments the second complementarity domain is 5, 6, 7, 8, 9, 10, 11, 12, 13, 14, 15, 16, 17, 18, 19, 20, 21, 22, 23, 24, 25, or 26 nucleotides in length. In certain embodiments, the first and second complementarity domains are each independently 6+/−2, 7+/−2, 8+/−2, 9+/−2, 10+/−2, 11+/−2, 12+/−2, 13+/−2, 14+/−2, 15+/−2, 16+/−2, 17+/−2, 18+/−2, 19+/−2, or 20+/−2, 21+/−2, 22+/−2, 23+/−2, or 24+/−2 nucleotides in length. In certain embodiments, the second complementarity domain is longer than the first complementarity domain, e.g., 2, 3, 4, 5, or 6 nucleotides longer.

In certain embodiments, the first and/or second complementarity domains each independently comprise three subdomains, which, in the 5' to 3' direction are: a 5' subdomain, a central subdomain, and a 3' subdomain. In certain embodiments, the 5' subdomain and 3' subdomain of the first complementarity domain are fully or partially complementary to the 3' subdomain and 5' subdomain, respectively, of the second complementarity domain.

In certain embodiments, the 5' subdomain of the first complementarity domain is 4 to 9 nucleotides in length, and in certain of these embodiments the 5' domain is 4, 5, 6, 7, 8, or 9 nucleotides in length. In certain embodiments, the 5' subdomain of the second complementarity domain is 3 to 25, 4 to 22, 4 to 18, or 4 to 10 nucleotides in length, and in certain of these embodiments the 5' domain is 3, 4, 5, 6, 7, 8, 9, 10, 11, 12, 13, 14, 15, 16, 17, 18, 19, 20, 21, 22, 23, 24, or 25 nucleotides in length. In certain embodiments, the central subdomain of the first complementarity domain is 1, 2, or 3 nucleotides in length. In certain embodiments, the central subdomain of the second complementarity domain is 1, 2, 3, 4, or 5 nucleotides in length. In certain embodiments, the 3' subdomain of the first complementarity domain is 3 to 25, 4 to 22, 4 to 18, or 4 to 10 nucleotides in length, and in certain of these embodiments the 3' subdomain is 3, 4, 5, 6, 7, 8, 9, 10, 11, 12, 13, 14, 15, 16, 17, 18, 19, 20, 21, 22, 23, 24, or 25 nucleotides in length. In certain embodiments, the 3' subdomain of the second complementarity domain is 4 to 9, e.g., 4, 5, 6, 7, 8 or 9 nucleotides in length.

The first and/or second complementarity domains can share homology with, or be derived from, naturally occurring or reference first and/or second complementarity domain. In certain of these embodiments, the first and/or second complementarity domains have at least 50%, 60%, 70%, 80%, 85%, 90%, or 95% homology with, or differ by no more than 1, 2, 3, 4, 5, or 6 nucleotides from, the naturally occurring or reference first and/or second complementarity domain. In certain of these embodiments, the first and/or second complementarity domains may have at least 50%, 60%, 70%, 80%, 85%, 90%, or 95% homology with homology with a first and/or second complementarity domain from S. pyogenes or S. aureus.

In certain embodiments, the first and/or second complementarity domains do not comprise any modifications. In other embodiments, the first and/or second complementarity domains or one or more nucleotides therein have a modification, including but not limited to a modification set forth below. In certain embodiments, one or more nucleotides of the first and/or second complementarity domain may comprise a 2' modification (e.g., a modification at the 2' position on ribose), e.g., a 2-acetylation, e.g., a 2' methylation. In certain embodiments, the backbone of the targeting domain can be modified with a phosphorothioate. In certain embodiments, modifications to one or more nucleotides of the first and/or second complementarity domain render the first and/or second complementarity domain and/or the gRNA comprising the first and/or second complementarity less susceptible to degradation or more bio-compatible, e.g., less immunogenic. In certain embodiments, the first and/or second complementarity domains each independently include 1, 2, 3, 4, 5, 6, 7, or 8 or more modifications, and in certain of these embodiments the first and/or second complementarity domains each independently include 1, 2, 3, or 4 modifications within five nucleotides of their respective 5' ends, 3' ends, or both their 5' and 3' ends. In other embodiments, the first and/or second complementarity domains each independently contain no modifications within five nucleotides of their respective 5' ends, 3' ends, or both their 5' and 3' ends. In certain embodiments, one or both of the first and second complementarity domains comprise modifications at two or more consecutive nucleotides.

In certain embodiments, modifications to one or more nucleotides in the first and/or second complementarity domains are selected to not interfere with targeting efficacy, which can be evaluated by testing a candidate modification in a system as set forth below. gRNAs having a candidate first or second complementarity domain having a selected length, sequence, degree of complementarity, or degree of modification can be evaluated in a system as set forth below. The candidate complementarity domain can be placed, either alone or with one or more other candidate changes in a gRNA molecule/Cas9 molecule system known to be functional with a selected target, and evaluated.

In certain embodiments, the duplexed region formed by the first and second complementarity domains is, for example, 6, 7, 8, 9, 10, 11, 12, 13, 14, 15, 16, 17, 18, 19, 20, 21, or 22 bp in length, excluding any looped out or unpaired nucleotides.

In certain embodiments, the first and second complementarity domains, when duplexed, comprise 11 paired nucleotides (see, for e.g., gRNA of SEQ ID NO:48). In certain embodiments, the first and second complementarity domains, when duplexed, comprise 15 paired nucleotides (see, e.g., gRNA of SEQ ID NO:50). In certain embodiments, the first and second complementarity domains, when duplexed, comprise 16 paired nucleotides (see, e.g., gRNA of SEQ ID NO:51). In certain embodiments, the first and second complementarity domains, when duplexed, comprise 21 paired nucleotides (see, e.g., gRNA of SEQ ID NO:29).

In certain embodiments, one or more nucleotides are exchanged between the first and second complementarity domains to remove poly-U tracts. For example, nucleotides 23 and 48 or nucleotides 26 and 45 of the gRNA of SEQ ID NO:48 may be exchanged to generate the gRNA of SEQ ID NOs:49 or 31, respectively. Similarly, nucleotides 23 and 39 of the gRNA of SEQ ID NO:29 may be exchanged with nucleotides 50 and 68 to generate the gRNA of SEQ ID NO:30.

Linking Domain

The linking domain is disposed between and serves to link the first and second complementarity domains in a unimolecular or chimeric gRNA. In certain embodiments, part of the linking domain is from a crRNA-derived region, and another part is from a tracrRNA-derived region.

In certain embodiments, the linking domain links the first and second complementarity domains covalently. In certain of these embodiments, the linking domain consists of or comprises a covalent bond. In other embodiments, the linking domain links the first and second complementarity domains non-covalently. In certain embodiments, the linking domain is ten or fewer nucleotides in length, e.g., 1, 2, 3, 4, 5, 6, 7, 8, 9, or 10 nucleotides. In other embodiments, the linking domain is greater than 10 nucleotides in length, e.g., 11, 12, 13, 14, 15, 16, 17, 18, 19, 20, 21, 22, 23, 24, or 25 or more nucleotides. In certain embodiments, the linking domain is 2 to 50, 2 to 40, 2 to 30, 2 to 20, 2 to 10, 2 to 5, 10 to 100, 10 to 90, 10 to 80, 10 to 70, 10 to 60, 10 to 50, 10 to 40, 10 to 30, 10 to 20, 10 to 15, 20 to 100, 20 to 90, 20 to 80, 20 to 70, 20 to 60, 20 to 50, 20 to 40, 20 to 30, or 20 to 25 nucleotides in length. In certain embodiments, the linking domain is 10+/−5, 20+/−5, 20+/−10, 30+/−5, 30+/−10, 40+/−5, 40+/−10, 50+/−5, 50+/−10, 60+/−5, 60+/−10, 70+/−5, 70+/−10, 80+/−5, 80+/−10, 90+/−5, 90+/−10, 100+/−5, or 100+/−10 nucleotides in length.

In certain embodiments, the linking domain shares homology with, or is derived from, a naturally occurring sequence, e.g., the sequence of a tracrRNA that is 5' to the second complementarity domain. In certain embodiments, the linking domain has at least 50%, 60%, 70%, 80%, 90%, or 95% homology with or differs by no more than 1, 2, 3, 4, 5, or 6 nucleotides from a linking domain disclosed herein.

In certain embodiments, the linking domain does not comprise any modifications. In other embodiments, the linking domain or one or more nucleotides therein have a modification, including but not limited to the modifications set forth below. In certain embodiments, one or more nucleotides of the linking domain may comprise a 2' modification (e.g., a modification at the 2' position on ribose), e.g., a 2-acetylation, e.g., a 2' methylation. In certain embodiments, the backbone of the linking domain can be modified with a phosphorothioate. In certain embodiments, modifications to one or more nucleotides of the linking domain render the linking domain and/or the gRNA comprising the linking domain less susceptible to degradation or more bio-compatible, e.g., less immunogenic. In certain embodiments, the linking domain includes 1, 2, 3, 4, 5, 6, 7, or 8 or more modifications, and in certain of these embodiments the linking domain includes 1, 2, 3, or 4 modifications within five nucleotides of its 5' and/or 3' end. In certain embodiments, the linking domain comprises modifications at two or more consecutive nucleotides.

In certain embodiments, modifications to one or more nucleotides in the linking domain are selected to not interfere with targeting efficacy, which can be evaluated by testing a candidate modification in a system as set forth below. gRNAs having a candidate linking domain having a selected length, sequence, degree of complementarity, or degree of modification can be evaluated in a system as set forth below. The candidate linking domain can be placed, either alone or with one or more other candidate changes in a gRNA molecule/Cas9 molecule system known to be functional with a selected target, and evaluated.

In certain embodiments, the linking domain comprises a duplexed region, typically adjacent to or within 1, 2, or 3 nucleotides of the 3' end of the first complementarity domain and/or the 5' end of the second complementarity domain. In certain of these embodiments, the duplexed region of the linking region is 10+/−5, 15+/−5, 20+/−5, 20+/−10, or 30+/−5 bp in length. In certain embodiments, the duplexed region of the linking domain is 1, 2, 3, 4, 5, 6, 7, 8, 9, 10, 11, 12, 13, 14, or 15 bp in length. In certain embodiments, the sequences forming the duplexed region of the linking domain are fully complementarity. In other embodiments, one or both of the sequences forming the duplexed region contain one or more nucleotides (e.g., 1, 2, 3, 4, 5, 6, 7, or 8 nucleotides) that are not complementary with the other duplex sequence.

5' Extension Domain

In certain embodiments, a modular gRNA as disclosed herein comprises a 5' extension domain, i.e., one or more additional nucleotides 5' to the second complementarity domain. In certain embodiments, the 5' extension domain is 2 to 10 or more, 2 to 9, 2 to 8, 2 to 7, 2 to 6, 2 to 5, or 2 to 4 nucleotides in length, and in certain of these embodiments the 5' extension domain is 2, 3, 4, 5, 6, 7, 8, 9, or 10 or more nucleotides in length.

In certain embodiments, the 5' extension domain nucleotides do not comprise modifications, e.g., modifications of the type provided below. However, in certain embodiments, the 5' extension domain comprises one or more modifications, e.g., modifications that it render it less susceptible to degradation or more bio-compatible, e.g., less immunogenic. By way of example, the backbone of the 5' extension domain can be modified with a phosphorothioate, or other modification(s) as set forth below. In certain embodiments, a nucleotide of the 5' extension domain can comprise a 2' modification (e.g., a modification at the 2' position on ribose), e.g., a 2-acetylation, e.g., a 2' methylation, or other modification(s) as set forth below.

In certain embodiments, the 5' extension domain can comprise as many as 1, 2, 3, 4, 5, 6, 7, or 8 modifications. In certain embodiments, the 5' extension domain comprises as many as 1, 2, 3, or 4 modifications within 5 nucleotides of its 5' end, e.g., in a modular gRNA molecule. In certain embodiments, the 5' extension domain comprises as many as 1, 2, 3, or 4 modifications within 5 nucleotides of its 3' end, e.g., in a modular gRNA molecule.

In certain embodiments, the 5' extension domain comprises modifications at two consecutive nucleotides, e.g., two consecutive nucleotides that are within 5 nucleotides of the 5' end of the 5' extension domain, within 5 nucleotides of the 3' end of the 5' extension domain, or more than 5 nucleotides away from one or both ends of the 5' extension domain. In certain embodiments, no two consecutive nucleotides are modified within 5 nucleotides of the 5' end of the 5' extension domain, within 5 nucleotides of the 3' end of the 5' extension domain, or within a region that is more than 5 nucleotides away from one or both ends of the 5' extension domain. In certain embodiments, no nucleotide is modified within 5 nucleotides of the 5' end of the 5' extension domain, within 5 nucleotides of the 3' end of the 5' extension domain, or within a region that is more than 5 nucleotides away from one or both ends of the 5' extension domain.

Modifications in the 5' extension domain can be selected so as to not interfere with gRNA molecule efficacy, which can be evaluated by testing a candidate modification in a system as set forth below. gRNAs having a candidate 5' extension domain having a selected length, sequence, degree of complementarity, or degree of modification, can be evaluated in a system as set forth below. The candidate 5' extension domain can be placed, either alone, or with one or more other candidate changes in a gRNA molecule/Cas9 molecule system known to be functional with a selected target and evaluated.

In certain embodiments, the 5' extension domain has at least 60, 70, 80, 85, 90, or 95% homology with, or differs by no more than 1, 2, 3, 4, 5, or 6 nucleotides from, a reference 5' extension domain, e.g., a naturally occurring, e.g., an *S. pyogenes, S. aureus*, or *S. thermophilus,* 5' extension domain, or a 5' extension domain described herein.

Proximal Domain

In certain embodiments, the proximal domain is 5 to 20 or more nucleotides in length, e.g., 5, 6, 7, 8, 9, 10, 11, 12, 13, 14, 15, 16, 17, 18, 19, 20, 21, 22, 23, 24, 25, or 26 nucleotides in length. In certain of these embodiments, the proximal domain is 6+/−2, 7+/−2, 8+/−2, 9+/−2, 10+/−2, 11+/−2, 12+/−2, 13+/−2, 14+/−2, 14+/−2, 16+/−2, 17+/−2, 18+/−2, 19+/−2, or 20+/−2 nucleotides in length. In certain embodiments, the proximal domain is 5 to 20, 7, to 18, 9 to 16, or 10 to 14 nucleotides in length.

In certain embodiments, the proximal domain can share homology with or be derived from a naturally occurring proximal domain. In certain of these embodiments, the proximal domain has at least 50%, 60%, 70%, 80%, 85%, 90%, or 95% homology with or differs by no more than 1, 2, 3, 4, 5, or 6 nucleotides from a proximal domain disclosed herein, e.g., an *S. pyogenes, S. aureus,* or *S. thermophilus* proximal domain.

In certain embodiments, the proximal domain does not comprise any modifications. In other embodiments, the proximal domain or one or more nucleotides therein have a modification, including but not limited to the modifications set forth in herein. In certain embodiments, one or more nucleotides of the proximal domain may comprise a 2' modification (e.g., a modification at the 2' position on ribose), e.g., a 2-acetylation, e.g., a 2' methylation. In certain embodiments, the backbone of the proximal domain can be modified with a phosphorothioate. In certain embodiments, modifications to one or more nucleotides of the proximal domain render the proximal domain and/or the gRNA comprising the proximal domain less susceptible to degradation or more bio-compatible, e.g., less immunogenic. In certain embodiments, the proximal domain includes 1, 2, 3, 4, 5, 6, 7, or 8 or more modifications, and in certain of these embodiments the proximal domain includes 1, 2, 3, or 4 modifications within five nucleotides of its 5' and/or 3' end. In certain embodiments, the proximal domain comprises modifications at two or more consecutive nucleotides.

In certain embodiments, modifications to one or more nucleotides in the proximal domain are selected to not interfere with targeting efficacy, which can be evaluated by testing a candidate modification in a system as set forth below. gRNAs having a candidate proximal domain having a selected length, sequence, degree of complementarity, or degree of modification can be evaluated in a system as set forth below. The candidate proximal domain can be placed, either alone or with one or more other candidate changes in a gRNA molecule/Cas9 molecule system known to be functional with a selected target, and evaluated.

Tail Domain

A broad spectrum of tail domains are suitable for use in the gRNA molecules disclosed herein.

In certain embodiments, the tail domain is absent. In other embodiments, the tail domain is 1 to 100 or more nucleotides in length, e.g., 1, 2, 3, 4, 5, 6, 7, 8, 9, 10, 20, 30, 40, 50, 60, 70, 80, 90, or 100 nucleotides in length. In certain embodiments, the tail domain is 1 to 5, 1 to 10, 1 to 15, 1 to 20, 1 to 50, 10 to 100, 20 to 100, 10 to 90, 20 to 90, 10 to 80, 20 to 80, 10 to 70, 20 to 70, 10 to 60, 20 to 60, 10 to 50, 20 to 50, 10 to 40, 20 to 40, 10 to 30, 20 to 30, 20 to 25, 10 to 20, or 10 to 15 nucleotides in length. In certain embodiments, the tail domain is 5+/−5, 10+/−5, 20+/−10, 20+/−5, 25+/−10, 30+/−10, 30+/−5, 40+/−10, 40+/−5, 50+/−10, 50+/−5, 60+/−10, 60+/−5, 70+/−10, 70+/−5, 80+/−10, 80+/−5, 90+/−10, 90+/−5, 100+/−10, or 100+/−5 nucleotides in length, In certain embodiments, the tail domain can share homology with or be derived from a naturally occurring tail domain or the 5' end of a naturally occurring tail domain. In certain of these embodiments, the proximal domain has at least 50%, 60%, 70%, 80%, 85%, 90%, or 95% homology with or differs by no more than 1, 2, 3, 4, 5, or 6 nucleotides from a naturally occurring tail domain disclosed herein, e.g., an *S. pyogenes, S. aureus,* or *S. thermophilus* tail domain.

In certain embodiments, the tail domain includes sequences that are complementary to each other and which, under at least some physiological conditions, form a duplexed region. In certain of these embodiments, the tail domain comprises a tail duplex domain which can form a tail duplexed region. In certain embodiments, the tail duplexed region is 3, 4, 5, 6, 7, 8, 9, 10, 11, or 12 bp in length. In certain embodiments, the tail domain comprises a single stranded domain 3' to the tail duplex domain that does not form a duplex. In certain of these embodiments, the single stranded domain is 3 to 10 nucleotides in length, e.g., 3, 4, 5, 6, 7, 8, 9, 10, or 4 to 6 nucleotides in length.

In certain embodiments, the tail domain does not comprise any modifications. In other embodiments, the tail domain or one or more nucleotides therein have a modification, including but not limited to the modifications set forth herein. In certain embodiments, one or more nucleotides of the tail domain may comprise a 2' modification (e.g., a modification at the 2' position on ribose), e.g., a 2-acetylation, e.g., a 2' methylation. In certain embodiments, the backbone of the tail domain can be modified with a phosphorothioate. In certain embodiments, modifications to one or more nucleotides of the tail domain render the tail domain and/or the gRNA comprising the tail domain less susceptible to degradation or more bio-compatible, e.g., less immunogenic. In certain embodiments, the tail domain includes 1, 2, 3, 4, 5, 6, 7, or 8 or more modifications, and in certain of these embodiments the tail domain includes 1, 2, 3, or 4 modifications within five nucleotides of its 5' and/or 3' end. In certain embodiments, the tail domain comprises modifications at two or more consecutive nucleotides.

In certain embodiments, modifications to one or more nucleotides in the tail domain are selected to not interfere with targeting efficacy, which can be evaluated by testing a candidate modification as set forth below. gRNAs having a candidate tail domain having a selected length, sequence, degree of complementarity, or degree of modification can be evaluated using a system as set forth below. The candidate tail domain can be placed, either alone or with one or more other candidate changes in a gRNA molecule/Cas9 molecule system known to be functional with a selected target, and evaluated.

In certain embodiments, the tail domain includes nucleotides at the 3' end that are related to the method of in vitro or in vivo transcription. When a T7 promoter is used for in vitro transcription of the gRNA, these nucleotides may be any nucleotides present before the 3' end of the DNA template. When a U6 promoter is used for in vivo transcription, these nucleotides may be the sequence UUUUUU. When an H1 promoter is used for transcription, these nucleotides may be the sequence UUUU. When alternate pol-III promoters are used, these nucleotides may be various numbers of uracil bases depending on, e.g., the termination signal of the pol-III promoter, or they may include alternate bases.

In certain embodiments, the proximal and tail domain taken together comprise, consist of, or consist essentially of the sequence set forth in SEQ ID NOs:32, 33, 34, 35, 36, or 37.

Exemplary Unimolecular/Chimeric gRNAs

In certain embodiments, a gRNA as disclosed herein has the structure: 5' [targeting domain]-[first complementarity domain]-[linking domain]-[second complementarity domain]-[proximal domain]-[tail domain]-3', wherein:

the targeting domain comprises a core domain and optionally a secondary domain, and is 10 to 50 nucleotides in length;

the first complementarity domain is 5 to 25 nucleotides in length and, in certain embodiments has at least 50, 60, 70, 80, 85, 90, or 95% homology with a reference first complementarity domain disclosed herein;

the linking domain is 1 to 5 nucleotides in length;

the second complementarity domain is 5 to 27 nucleotides in length and, in certain embodiments has at least 50, 60, 70, 80, 85, 90, or 95% homology with a reference second complementarity domain disclosed herein;

the proximal domain is 5 to 20 nucleotides in length and, in certain embodiments has at least 50, 60, 70, 80, 85, 90, or 95% homology with a reference proximal domain disclosed herein; and the tail domain is absent or a nucleotide sequence is 1 to 50 nucleotides in length and, in certain embodiments has at least 50, 60, 70, 80, 85, 90, or 95% homology with a reference tail domain disclosed herein.

In certain embodiments, a unimolecular gRNA as disclosed herein comprises, preferably from 5' to 3': a targeting domain, e.g., comprising 10-50 nucleotides; a first complementarity domain, e.g., comprising 15, 16, 17, 18, 19, 20, 21, 22, 23, 24, 25, or 26 nucleotides; a linking domain; a second complementarity domain; a proximal domain; and a tail domain, wherein,
  (a) the proximal and tail domain, when taken together, comprise at least 15, 18, 20, 25, 30, 31, 35, 40, 45, 49, 50, or 53 nucleotides;
  (b) there are at least 15, 18, 20, 25, 30, 31, 35, 40, 45, 49, 50, or 53 nucleotides 3' to the last nucleotide of the second complementarity domain; or
  (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the sequence from (a), (b), and/or (c) has at least 50%, 60%, 70%, 75%, 80%, 85%, 90%, 95%, or 99% homology with the corresponding sequence of a naturally occurring gRNA, or with a gRNA described herein.

In certain embodiments, the proximal and tail domain, when taken together, comprise at least 15, 18, 20, 25, 30, 31, 35, 40, 45, 49, 50, or 53 nucleotides.

In certain embodiments, there are at least 15, 18, 20, 25, 30, 31, 35, 40, 45, 49, 50, or 53 nucleotides 3' to the last nucleotide of the second complementarity domain.

In certain embodiments, there are at least 16, 19, 21, 26, 31, 32, 36, 41, 46, 50, 51, or 54 nucleotides 3' to the last nucleotide of the second complementarity domain that are complementary to the corresponding nucleotides of the first complementarity domain.

In certain embodiments, the targeting domain consists of, consists essentially of, or comprises 16, 17, 18, 19, 20, 21, 22, 23, 24, 25, or 26 nucleotides (e.g., 16, 17, 18, 19, 20, 21, 22, 23, 24, 25, or 26 consecutive nucleotides) complementary or partially complementary to the target domain or a portion thereof, e.g., the targeting domain is 16, 17, 18, 19, 20, 21, 22, 23, 24, 25, or 26 nucleotides in length. In certain of these embodiments, the targeting domain is complementary to the target domain over the entire length of the targeting domain, the entire length of the target domain, or both.

In certain embodiments, a unimolecular or chimeric gRNA molecule disclosed herein (comprising a targeting domain, a first complementary domain, a linking domain, a second complementary domain, a proximal domain and, optionally, a tail domain) comprises the amino acid sequence set forth in SEQ ID NO:42, wherein the targeting domain is listed as 20 N's (residues 1-20) but may range in length from 16 to 26 nucleotides, and wherein the final six residues (residues 97-102) represent a termination signal for the U6 promoter buy may be absent or fewer in number. In certain embodiments, the unimolecular, or chimeric, gRNA molecule is a S. pyogenes gRNA molecule.

In certain embodiments, a unimolecular or chimeric gRNA molecule disclosed herein (comprising a targeting domain, a first complementary domain, a linking domain, a second complementary domain, a proximal domain and, optionally, a tail domain) comprises the amino acid sequence set forth in SEQ ID NO:38, wherein the targeting domain is listed as 20 Ns (residues 1-20) but may range in length from 16 to 26 nucleotides, and wherein the final six residues (residues 97-102) represent a termination signal for the U6 promoter but may be absent or fewer in number. In certain embodiments, the unimolecular or chimeric gRNA molecule is an S. aureus gRNA molecule.

Exemplary Modular gRNAs

In certain embodiments, a modular gRNA disclosed herein comprises: a first strand comprising, preferably from 5' to 3': a targeting domain, e.g., comprising 15, 16, 17, 18, 19, 20, 21, 22, 23, 24, 25, or 26 nucleotides; a first complementarity domain; and a second strand, comprising, preferably from 5' to 3': optionally a 5' extension domain; a second complementarity domain; a proximal domain; and a tail domain, wherein:
  (a) the proximal and tail domain, when taken together, comprise at least 15, 18, 20, 25, 30, 31, 35, 40, 45, 49, 50, or 53 nucleotides;
  (b) there are at least 15, 18, 20, 25, 30, 31, 35, 40, 45, 49, 50, or 53 nucleotides 3' to the last nucleotide of the second complementarity domain; or
  (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the sequence from (a), (b), or (c), has at least 60, 75, 80, 85, 90, 95, or 99% homology with the corresponding sequence of a naturally occurring gRNA, or with a gRNA described herein.

In certain embodiments, the proximal and tail domain, when taken together, comprise at least 15, 18, 20, 25, 30, 31, 35, 40, 45, 49, 50, or 53 nucleotides.

In certain embodiments, there are at least 15, 18, 20, 25, 30, 31, 35, 40, 45, 49, 50, or 53 nucleotides 3' to the last nucleotide of the second complementarity domain.

In certain embodiments, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 16, 17, 18, 19, 20, 21, 22, 23, 24, 25, or 26 nucleotides (e.g., 16, 17, 18, 19, 20, 21, 22, 23, 24, 25, or 26 consecutive nucleotides) having complementarity with the target domain, e.g., the targeting domain is 16, 17, 18, 19, 20, 21, 22, 23, 24, 25, or 26 nucleotides in length.

In certain embodiments, the targeting domain consists of, consists essentially of, or comprises 16, 17, 18, 19, 20, 21, 22, 23, 24, 25, or 26 nucleotides (e.g., 16, 17, 18, 19, 20, 21, 22, 23, 24, 25, or 26 consecutive nucleotides) complementary to the target domain or a portion thereof. In certain of these embodiments, the targeting domain is complementary to the target domain over the entire length of the targeting domain, the entire length of the target domain, or both.

Methods for Designing gRNAs

Methods for designing gRNAs are described herein, including Methods for selecting, designing, and validating target domains. Exemplary targeting domains are also provided herein. Targeting domains discussed herein can be incorporated into the gRNAs described herein.

Methods for selection and validation of target sequences as well as off-target analyses have been described previously, e.g., in Mali et al., 2013 SCIENCE 339(6121): 823-826; Hsu et al. NAT BIOTECHNOL, 31(9): 827-32; Fu et al., 2014 NAT BIOTECHNOL 32(3): 279-84, doi: 10.1038/nbt.2808. PubMed PMID: 24463574; Heigwer et al., 2014 NAT METHODS 11(2): 122-3. doi: 10.1038/nmeth.2812. PubMed PMID: 24481216; Bae et al. (2014) BIOINFORMATICS 30(10): 1473-5, PubMed PMID: 24463181; Xiao A et al. (2014) BIOINFORMATICS 30(8): 1180-1182, PubMed PMID: 24389662. Additional considerations for designing gRNAs are discussed in the section entitled "gRNA Design" in International Application PCT/US2014/057905. For example, a software tool can be used to optimize the choice of potential targeting domains corresponding to a user's target sequence, e.g., to minimize total off-target activity across the genome. Off-target activity may be other than cleavage. For each possible targeting domain choice using *S. pyogenes* Cas9, the tool can identify all off-target sequences (preceding either NAG or NGG PAMs) across the genome that contain up to certain number (e.g., 1, 2, 3, 4, 5, 6, 7, 8, 9, or 10) of mismatched base-pairs. The cleavage efficiency at each off-target sequence can be predicted, e.g., using an experimentally-derived weighting scheme. Each possible targeting domain is then ranked according to its total predicted off-target cleavage; the top-ranked targeting domains represent those that are likely to have the greatest on-target cleavage and the least off-target cleavage. Other functions, e.g., automated reagent design for CRISPR construction, primer design for the on-target Surveyor assay, and primer design for high-throughput detection and quantification of off-target cleavage via next-gen sequencing, can also be included in the tool. Candidate targeting domains and gRNAs comprising those targeting domains can be functionally evaluated using methods known in the art and/or as set forth herein.

In an embodiment, the targeting domain of a gRNA molecule is configured to avoid unwanted target chromosome elements, such as repeat elements, e.g., Alu repeats, in the target domain. The gRNA molecule may be a first, second, third and/or fourth gRNA molecule.

In certain embodiments, two or more (e.g., three or four) gRNA molecules are used with one Cas9 molecule. In another embodiment, when two or more (e.g., three or four) gRNAs are used with two or more Cas9 molecules, at least one Cas9 molecule is from a different species than the other Cas9 molecule(s). For example, when two gRNA molecules are used with two Cas9 molecules, one Cas9 molecule can be from one species and the other Cas9 molecule can be from a different species. Both Cas9 species are used to generate a single or double-strand break, as desired.

When two gRNAs are designed for use with two Cas9 molecules, the two Cas9 molecules may be different species. Both Cas9 species may be used to generate a single or double-strand break, as desired.

It is contemplated herein that any upstream gRNA described herein may be paired with any downstream gRNA described herein. When an upstream gRNA designed for use with one species of Cas9 is paired with a downstream gRNA designed for use from a different species of Cas9, both Cas9 species are used to generate a single or double-strand break, as desired.

Cas9 Molecules

Cas9 molecules of a variety of species can be used in the methods and compositions described herein. While *S. pyogenes* and *S. aureus* Cas9 molecules are the subject of much of the disclosure herein, Cas9 molecules of, derived from, or based on the Cas9 proteins of other species listed herein can be used as well. These include, for example, Cas9 molecules from *Acidovorax avenae, Actinobacillus pleuropneumoniae, Actinobacillus succinogenes, Actinobacillus suis, Actinomyces* sp., *cycliphilus denitrificans, Aminomonas paucivorans, Bacillus cereus, Bacillus smithii, Bacillus thuringiensis, Bacteroides* sp., *Blastopirellula marina, Bradyrhizobium* sp., *Brevibacillus laterosporus, Campylobacter coli, Campylobacter jejuni, Campylobacter lari, Candidatus Puniceispirillum, Clostridium cellulolyticum, Clostridium perfringens, Corynebacterium accolens, Corynebacterium diphtheria, Corynebacterium matruchotii, Dinoroseobacter shibae, Eubacterium dolichum*, gamma proteobacterium, *Gluconacetobacter diazotrophicus, Haemophilus parainfluenzae, Haemophilus sputorum, Helicobacter canadensis, Helicobacter cinaedi, Helicobacter mustelae, Ilyobacter polytropus, Kingella kingae, Lactobacillus crispatus, Listeria ivanovii, Listeria monocytogenes, Listeriaceae bacterium, Methylocystis* sp., *Methylosinus trichosporium, Mobiluncus mulieris, Neisseria bacilliformis, Neisseria cinerea, Neisseria flavescens, Neisseria lactamica, Neisseria* sp., *Neisseria wadsworthii, Nitrosomonas* sp., *Parvibaculum lavamentivorans, Pasteurella multocida, Phascolarctobacterium succinatutens, Ralstonia syzygii, Rhodopseudomonas palustris, Rhodovulum* sp., *Simonsiella muelleri, Sphingomonas* sp., *Sporolactobacillus vineae, Staphylococcus lugdunensis, Streptococcus* sp., *Subdoligranulum* sp., *Tistrella mobilis, Treponema* sp., or *Verminephrobacter eiseniae.*

Cas9 Domains

Crystal structures have been determined for two different naturally occurring bacterial Cas9 molecules (Jinek et al., SCIENCE, 343(6176):1247997, 2014) and for *S. pyogenes* Cas9 with a guide RNA (e.g., a synthetic fusion of crRNA and tracrRNA) (Nishimasu et al., CELL, 156:935-949, 2014; and Anders et al., NATURE, 2014, doi: 10.1038/nature13579).

A naturally occurring Cas9 molecule comprises two lobes: a recognition (REC) lobe and a nuclease (NUC) lobe; each of which further comprise domains described herein. The domain nomenclature and the numbering of the amino acid residues encompassed by each domain used throughout this disclosure is as described in Nishimasu et al. The numbering of the amino acid residues is with reference to Cas9 from *S. pyogenes.*

The REC lobe comprises the arginine-rich bridge helix (BH), the REC1 domain, and the REC2 domain. The REC lobe does not share structural similarity with other known proteins, indicating that it is a Cas9-specific functional domain. The BH domain is a long α helix and arginine rich region and comprises amino acids 60-93 of the sequence of S. pyogenes Cas9. The REC1 domain is important for recognition of the repeat:anti-repeat duplex, e.g., of a gRNA or a tracrRNA, and is therefore critical for Cas9 activity by recognizing the target sequence. The REC1 domain comprises two REC1 motifs at amino acids 94 to 179 and 308 to 717 of the sequence of S. pyogenes Cas9. These two REC1 domains, though separated by the REC2 domain in the linear primary structure, assemble in the tertiary structure to form the REC1 domain. The REC2 domain, or parts thereof, may also play a role in the recognition of the repeat:anti-repeat duplex. The REC2 domain comprises amino acids 180-307 of the sequence of S. pyogenes Cas9.

The NUC lobe comprises the RuvC domain, the HNH domain, and the PAM-interacting (PI) domain. The RuvC domain shares structural similarity to retroviral integrase superfamily members and cleaves a single strand, e.g., the non-complementary strand of the target nucleic acid molecule. The RuvC domain is assembled from the three split RuvC motifs (RuvC I, RuvCII, and RuvCIII, which are often commonly referred to in the art as RuvCI domain, or N-terminal RuvC domain, RuvCII domain, and RuvCIII domain) at amino acids 1-59, 718-769, and 909-1098, respectively, of the sequence of S. pyogenes Cas9. Similar to the REC1 domain, the three RuvC motifs are linearly separated by other domains in the primary structure, however in the tertiary structure, the three RuvC motifs assemble and form the RuvC domain. The HNH domain shares structural similarity with HNH endonucleases and cleaves a single strand, e.g., the complementary strand of the target nucleic acid molecule. The HNH domain lies between the RuvC II-III motifs and comprises amino acids 775-908 of the sequence of S. pyogenes Cas9. The PI domain interacts with the PAM of the target nucleic acid molecule, and comprises amino acids 1099-1368 of the sequence of S. pyogenes Cas9.

RuvC-Like Domain and HNH-Like Domain

In certain embodiments, a Cas9 molecule or Cas9 polypeptide comprises an HNH-like domain and a RuvC-like domain, and in certain of these embodiments cleavage activity is dependent on the RuvC-like domain and the HNH-like domain. A Cas9 molecule or Cas9 polypeptide can comprise one or more of a RuvC-like domain and an HNH-like domain. In certain embodiments, a Cas9 molecule or Cas9 polypeptide comprises a RuvC-like domain, e.g., a RuvC-like domain described below, and/or an HNH-like domain, e.g., an HNH-like domain described below.

RuvC-Like Domains

In certain embodiments, a RuvC-like domain cleaves a single strand, e.g., the non-complementary strand of the target nucleic acid molecule. The Cas9 molecule or Cas9 polypeptide can include more than one RuvC-like domain (e.g., one, two, three or more RuvC-like domains). In certain embodiments, a RuvC-like domain is at least 5, 6, 7, 8 amino acids in length but not more than 20, 19, 18, 17, 16 or 15 amino acids in length. In certain embodiments, the Cas9 molecule or Cas9 polypeptide comprises an N-terminal RuvC-like domain of about 10 to 20 amino acids, e.g., about 15 amino acids in length.

N-Terminal RuvC-Like Domains

Some naturally occurring Cas9 molecules comprise more than one RuvC-like domain with cleavage being dependent on the N-terminal RuvC-like domain. Accordingly, a Cas9 molecule or Cas9 polypeptide can comprise an N-terminal RuvC-like domain. Exemplary N-terminal RuvC-like domains are described below.

In certain embodiments, a Cas9 molecule or Cas9 polypeptide comprises an N-terminal RuvC-like domain comprising an amino acid sequence of Formula I:

(SEQ ID NO: 20)
$$D-X_1-G-X_2-X_3-X_4-X_5-G-X_6-X_7-X_8-X_9,$$

wherein, $X_1$ is selected from I, V, M, L, and T (e.g., selected from I, V, and L);

$X_2$ is selected from T, I, V, S, N, Y, E, and L (e.g., selected from T, V, and I);

$X_3$ is selected from N, S, G, A, D, T, R, M, and F (e.g., A or N);

$X_4$ is selected from S, Y, N, and F (e.g., S);

$X_5$ is selected from V, I, L, C, T, and F (e.g., selected from V, I and L);

$X_6$ is selected from W, F, V, Y, S, and L (e.g., W);

$X_7$ is selected from A, S, C, V, and G (e.g., selected from A and S);

$X_8$ is selected from V, I, L, A, M, and H (e.g., selected from V, I, M and L); and $X_9$ is selected from any amino acid or is absent (e.g., selected from T, V, I, L, A, F, S, A, Y, M, and R, or, e.g., selected from T, V, I, L, and A).

In certain embodiments, the N-terminal RuvC-like domain differs from a sequence of SEQ ID NO:20 by as many as 1 but no more than 2, 3, 4, or 5 residues.

In certain embodiments, the N-terminal RuvC-like domain is cleavage competent. In other embodiments, the N-terminal RuvC-like domain is cleavage incompetent.

In certain embodiments, a Cas9 molecule or Cas9 polypeptide comprises an N-terminal RuvC-like domain comprising an amino acid sequence of Formula II:

(SEQ ID NO: 21)
$$D-X_1-G-X_2-X_3-S-X_5-G-X_6-X_7-X_8-X_9,$$

wherein $X_1$ is selected from I, V, M, L, and T (e.g., selected from I, V, and L);

$X_2$ is selected from T, I, V, S, N, Y, E, and L (e.g., selected from T, V, and I);

$X_3$ is selected from N, S, G, A, D, T, R, M and F (e.g., A or N);

$X_5$ is selected from V, I, L, C, T, and F (e.g., selected from V, I and L);

$X_6$ is selected from W, F, V, Y, S, and L (e.g., W);

$X_7$ is selected from A, S, C, V, and G (e.g., selected from A and S);

$X_8$ is selected from V, I, L, A, M, and H (e.g., selected from V, I, M and L); and $X_9$ is selected from any amino acid or is absent (e.g., selected from T, V, I, L, A, F, S, A, Y, M, and R or selected from e.g., T, V, I, L, and A).

In certain embodiments, the N-terminal RuvC-like domain differs from a sequence of SEQ ID NO:21 by as many as 1 but not more than 2, 3, 4, or 5 residues.

In certain embodiments, the N-terminal RuvC-like domain comprises an amino acid sequence of Formula III:

$$\text{D-I-G-}X_2\text{-}X_3\text{-S-V-G-W-A-}X_8\text{-}X_9, \quad \text{(SEQ ID NO: 22)}$$

wherein $X_2$ is selected from T, I, V, S, N, Y, E, and L (e.g., selected from T, V, and I);

$X_3$ is selected from N, S, G, A, D, T, R, M, and F (e.g., A or N);

$X_8$ is selected from V, I, L, A, M, and H (e.g., selected from V, I, M and L); and $X_9$ is selected from any amino acid or is absent (e.g., selected from T, V, I, L, A, F, S, A, Y, M, and R or selected from e.g., T, V, I, L, and A).

In certain embodiments, the N-terminal RuvC-like domain differs from a sequence of SEQ ID NO:22 by as many as 1 but not more than, 2, 3, 4, or 5 residues.

In certain embodiments, the N-terminal RuvC-like domain comprises an amino acid sequence of Formula IV:

$$\text{D-I-G-T-N-S-V-G-W-A-V-X}, \quad \text{(SEQ ID NO: 23)}$$

wherein

X is a non-polar alkyl amino acid or a hydroxyl amino acid, e.g., X is selected from V, I, L, and T (e.g., the Cas9 molecule can comprise an N-terminal RuvC-like domain).

In certain embodiments, the N-terminal RuvC-like domain differs from a sequence of SEQ ID NO:23 by as many as 1 but not more than, 2, 3, 4, or 5 residues.

In certain embodiments, the N-terminal RuvC-like domain differs from a sequence of an N-terminal RuvC like domain disclosed herein, as many as 1 but no more than 2, 3, 4, or 5 residues. In an embodiment, 1, 2, 3 or all of the highly conserved residues are present.

In certain embodiments, the N-terminal RuvC-like domain differs from a sequence of an N-terminal RuvC-like domain disclosed herein, as many as 1 but no more than 2, 3, 4, or 5 residues. In an embodiment, 1, 2, or all of the highly conserved residues are present.

Additional RuvC-Like Domains

In addition to the N-terminal RuvC-like domain, the Cas9 molecule or Cas9 polypeptide can comprise one or more additional RuvC-like domains. In certain embodiments, the Cas9 molecule or Cas9 polypeptide can comprise two additional RuvC-like domains. Preferably, the additional RuvC-like domain is at least 5 amino acids in length and, e.g., less than 15 amino acids in length, e.g., 5 to 10 amino acids in length, e.g., 8 amino acids in length.

An additional RuvC-like domain can comprise an amino acid sequence of Formula V:

$$\text{I-}X_1\text{-}X_2\text{-E-}X_3\text{-A-R-E}, \quad \text{(SEQ ID NO: 15)}$$

wherein, $X_1$ is V or H;

$X_2$ is I, L or V (e.g., I or V); and $X_3$ is M or T.

In certain embodiments, the additional RuvC-like domain comprises an amino acid sequence of Formula VI:

$$\text{I-V-}X_2\text{-E-M-A-R-E}, \quad \text{(SEQ ID NO: 16)}$$

wherein $X_2$ is I, L or V (e.g., I or V) (e.g., the Cas9 molecule or Cas9 polypeptide can comprise an additional RuvC-like domain).

An additional RuvC-like domain can comprise an amino acid sequence of Formula VII:

$$\text{H-H-A-}X_1\text{-D-A-}X_2\text{-}X_3, \quad \text{(SEQ ID NO: 17)}$$

wherein $X_1$ is H or L;

$X_2$ is R or V; and $X_3$ is E or V.

In certain embodiments, the additional RuvC-like domain comprises the amino acid sequence:

$$\text{H-H-A-H-D-A-Y-L}. \quad \text{(SEQ ID NO: 18)}$$

In certain embodiments, the additional RuvC-like domain differs from a sequence of SEQ ID NOs:15-18 by as many as 1 but not more than 2, 3, 4, or 5 residues.

In certain embodiments, the sequence flanking the N-terminal RuvC-like domain has the amino acid sequence of Formula VIII:

$$\text{K-}X_1\text{'-Y-}X_2\text{'-}X_3\text{'-}X_4\text{'-Z-T-D-}X_9\text{'-Y}, \quad \text{(SEQ ID NO: 19)}$$

wherein $X_1$' is selected from K and P;

$X_2$' is selected from V, L, I, and F (e.g., V, I and L);

$X_3$' is selected from G, A and S (e.g., G);

$X_4$' is selected from L, I, V, and F (e.g., L);

$X_9$' is selected from D, E, N, and Q; and

Z is an N-terminal RuvC-like domain, e.g., as described above, e.g., having 5 to 20 amino acids.

HNH-Like Domains

In an embodiment, an HNH-like domain cleaves a single stranded complementary domain, e.g., a complementary strand of a double stranded nucleic acid molecule. In certain embodiments, an HNH-like domain is at least 15, 20, or 25 amino acids in length but not more than 40, 35, or 30 amino acids in length, e.g., 20 to 35 amino acids in length, e.g., 25 to 30 amino acids in length. Exemplary HNH-like domains are described below.

In an embodiment, a Cas9 molecule or Cas9 polypeptide comprises an HNH-like domain having an amino acid sequence of Formula IX:

$$X_1\text{-}X_2\text{-}X_3\text{-H-}X_4\text{-}X_5\text{-P-}X_6\text{-}X_7\text{-}X_8\text{-}X^9\text{-}X^{10}\text{-}X^{11}\text{-}X^{12}\text{-}X^{13}\text{-}X^{14}\text{-}X^{15}\text{-N-}X^{16}\text{-}X^{17}\text{-}X^{18}\text{-}X^{19}\text{-}X_{20}\text{-}X_{21}\text{-}X_{22}\text{-}X_{23}\text{-N}, \quad \text{(SEQ ID NO: 25)}$$

wherein $X_1$ is selected from D, E, Q and N (e.g., D and E);

$X^2$ is selected from L, I, R, Q, V, M, and K;

$X_3$ is selected from D and E;

$X_4$ is selected from I, V, T, A, and L (e.g., A, I and V);

$X_5$ is selected from V, Y, I, L, F, and W (e.g., V, I and L);

$X_6$ is selected from Q, H, R, K, Y, I, L, F, and W;

$X_7$ is selected from S, A, D, T, and K (e.g., S and A);

$X_8$ is selected from F, L, V, K, Y, M, I, R, A, E, D, and Q (e.g., F);

$X_9$ is selected from L, R, T, I, V, S, C, Y, K, F, and G;
$X_{10}$ is selected from K, Q, Y, T, F, L, W, M, A, E, G, and S;
$X_{11}$ is selected from D, S, N, R, L, and T (e.g., D);
$X_{12}$ is selected from D, N and S;
$X_{13}$ is selected from S, A, T, G, and R (e.g., S);
$X_{14}$ is selected from I, L, F, S, R, Y, Q, W, D, K, and H (e.g., I, L and F);
$X_{15}$ is selected from D, S, I, N, E, A, H, F, L, Q, M, G, Y, and V;
$X_{16}$ is selected from K, L, R, M, T, and F (e.g., L, R and K);
$X_{17}$ is selected from V, L, I, A and T;
$X_{18}$ is selected from L, I, V, and A (e.g., L and I);
$X_{19}$ is selected from T, V, C, E, S, and A (e.g., T and V);
$X_{20}$ is selected from R, F, T, W, E, L, N, C, K, V, S, Q, I, Y, H, and A;
$X_{21}$ is selected from S, P, R, K, N, A, H, Q, G, and L;
$X_{22}$ is selected from D, G, T, N, S, K, A, I, E, L, Q, R, and Y; and
$X_{23}$ is selected from K, V, A, E, Y, I, C, L, S, T, G, K, M, D, and F.

In certain embodiments, a HNH-like domain differs from a sequence of SEQ ID NO:25 by at least one but not more than, 2, 3, 4, or 5 residues.

In certain embodiments, the HNH-like domain is cleavage competent. In other embodiments, the HNH-like domain is cleavage incompetent.

In certain embodiments, a Cas9 molecule or Cas9 polypeptide comprises an HNH-like domain comprising an amino acid sequence of Formula X:

(SEQ ID NO: 26)
$X_1$-$X_2$-$X_3$-H-$X_4$-$X_5$-P-$X_6$-S-$X_8$-$X_9$-$X_{10}$-D-D-S-$X_{14}$-$X_{15}$-N-K-V-L-$X_{19}$-$X_{20}$-$X_{21}$-$X_{22}$-$X_{23}$-N, wherein
$X_1$ is selected from D and E;
$X_2$ is selected from L, I, R, Q, V, M, and K;
$X_3$ is selected from D and E;
$X_4$ is selected from I, V, T, A, and L (e.g., A, I and V);
$X_5$ is selected from V, Y, I, L, F, and W (e.g., V, I and L);
$X_6$ is selected from Q, H, R, K, Y, I, L, F, and W;
$X_8$ is selected from F, L, V, K, Y, M, I, R, A, E, D, and Q (e.g., F);
$X_9$ is selected from L, R, T, I, V, S, C, Y, K, F, and G;
$X_{10}$ is selected from K, Q, Y, T, F, L, W, M, A, E, G, and S;
$X_{14}$ is selected from I, L, F, S, R, Y, Q, W, D, K and H (e.g., I, L and F);
$X_{15}$ is selected from D, S, I, N, E, A, H, F, L, Q, M, G, Y, and V;
$X_{19}$ is selected from T, V, C, E, S, and A (e.g., T and V);
$X_{20}$ is selected from R, F, T, W, E, L, N, C, K, V, S, Q, I, Y, H, and A;
$X_{21}$ is selected from S, P, R, K, N, A, H, Q, G, and L;
$X_{22}$ is selected from D, G, T, N, S, K, A, I, E, L, Q, R, and Y; and
$X_{23}$ is selected from K, V, A, E, Y, I, C, L, S, T, G, K, M, D, and F.

In certain embodiment, the HNH-like domain differs from a sequence of SEQ ID NO:26 by 1, 2, 3, 4, or 5 residues.

In certain embodiments, a Cas9 molecule or Cas9 polypeptide comprises an HNH-like domain comprising an amino acid sequence of Formula XI:

(SEQ ID NO: 27)
$X_1$-V-$X_3$-H-I-V-P-$X_6$-S-$X_8$-$X_9$-$X_{10}$-D-D-S-$X_{14}$-$X_{15}$-N-K-V-L-T-$X_{20}$-$X_{21}$-$X_{22}$-$X_{23}$-N, wherein
$X_1$ is selected from D and E;
$X_3$ is selected from D and E;
$X_6$ is selected from Q, H, R, K, Y, I, L, and W;
$X_8$ is selected from F, L, V, K, Y, M, I, R, A, E, D, and Q (e.g., F);
$X_9$ is selected from L, R, T, I, V, S, C, Y, K, F, and G;
$X_{10}$ is selected from K, Q, Y, T, F, L, W, M, A, E, G, and S;
$X_{14}$ is selected from I, L, F, S, R, Y, Q, W, D, K, and H (e.g., I, L and F);
$X_{15}$ is selected from D, S, I, N, E, A, H, F, L, Q, M, G, Y, and V;
$X_{20}$ is selected from R, F, T, W, E, L, N, C, K, V, S, Q, I, Y, H, and A;
$X_{21}$ is selected from S, P, R, K, N, A, H, Q, G, and L;
$X_{22}$ is selected from D, G, T, N, S, K, A, I, E, L, Q, R, and Y; and
$X_{23}$ is selected from K, V, A, E, Y, I, C, L, S, T, G, K, M, D, and F.

In certain embodiments, the HNH-like domain differs from a sequence of SEQ ID NO:27 by 1, 2, 3, 4, or 5 residues.

In certain embodiments, a Cas9 molecule or Cas9 polypeptide comprises an HNH-like domain having an amino acid sequence of Formula XII:

(SEQ ID NO: 28)
D-$X_2$-D-H-I-$X_5$-P-Q-$X_7$-F-$X_9$-$X_{10}$-D-$X_{12}$-S-I-D-N-$X_{16}$-V-L-$X_{19}$-$X_{20}$-S-$X_{22}$-$X_{23}$-N, wherein
$X_2$ is selected from I and V;
$X_5$ is selected from I and V;
$X_7$ is selected from A and S;
$X_9$ is selected from I and L;
$X_{10}$ is selected from K and T;
$X_{12}$ is selected from D and N;
$X_{16}$ is selected from R, K, and L;
$X_{19}$ is selected from T and V;
$X_{20}$ is selected from S, and R;
$X_{22}$ is selected from K, D, and A; and
$X_{23}$ is selected from E, K, G, and N (e.g., the Cas9 molecule or Cas9 polypeptide can comprise an HNH-like domain as described herein).

In an embodiment, the HNH-like domain differs from a sequence of SEQ ID NO:28 by as many as 1 but no more than 2, 3, 4, or 5 residues.

In certain embodiments, a Cas9 molecule or Cas9 polypeptide comprises the amino acid sequence of Formula XIII:

(SEQ ID NO: 24)
L-Y-Y-L-Q-N-G-$X_1'$-D-M-Y-$X_2'$-$X_3'$-$X_4'$-$X_5'$-L-D-I-$X_6'$-$X_7'$-L-S-$X_8'$-Y-Z-N-R-$X_9'$-K-$X_{10}'$-D-$X_{11}'$-V-P, wherein
$X_1'$ is selected from K and R;
$X_2'$ is selected from V and T;
$X_3'$ is selected from G and D;
$X_4'$ is selected from E, Q and D;

$X_5'$ is selected from E and D;
$X_6'$ is selected from D, N, and H;
$X_7'$ is selected from Y, R, and N;
$X_8'$ is selected from Q, D, and N;
$X_9'$ is selected from G and E;
$X_{10}'$ is selected from S and G;
$X_{11}'$ is selected from D and N; and
Z is an HNH-like domain, e.g., as described above.

In certain embodiments, the Cas9 molecule or Cas9 polypeptide comprises an amino acid sequence that differs from a sequence of SEQ ID NO:24 by as many as 1 but not more than 2, 3, 4, or 5 residues.

In certain embodiments, the HNH-like domain differs from a sequence of an HNH-like domain disclosed herein, by as many as 1 but not more than 2, 3, 4, or 5 residues. In certain embodiments, 1 or both of the highly conserved residues are present.

In certain embodiments, the HNH-like domain differs from a sequence of an HNH-like domain disclosed herein, by as many as 1 but not more than 2, 3, 4, or 5 residues. In an embodiment, 1, 2, or all 3 of the highly conserved residues are present.

Cas9 Activities

In certain embodiments, the Cas9 nickase or Cas9 polypeptide is capable of cleaving a target nucleic acid molecule. Typically wild-type Cas9 molecules cleave both strands of a target nucleic acid molecule. Cas9 molecules and Cas9 polypeptides can be engineered to alter nuclease cleavage (or other properties), e.g., to provide a Cas9 molecule or Cas9 polypeptide which is a nickase, or which lacks the ability to cleave target nucleic acid. A Cas9 molecule or Cas9 polypeptide that is capable of cleaving a target nucleic acid molecule is referred to herein as an eaCas9 (an enzymatically active Cas9) molecule or eaCas9 polypeptide.

In certain embodiments, an eaCas9 molecule or eaCas9 polypeptide comprises one or more of the following enzymatic activities: a nickase activity, i.e., the ability to cleave a single strand, e.g., the non-complementary strand or the complementary strand, of a nucleic acid molecule; an endonuclease activity; an exonuclease activity; and a helicase activity, i.e., the ability to unwind the helical structure of a double stranded nucleic acid.

In certain embodiments, an enzymatically active or an eaCas9 molecule or eaCas9 polypeptide cleaves both DNA strands and results in a double stranded break. In certain embodiments, an eaCas9 molecule or eaCas9 polypeptide cleaves only one strand, e.g., the strand to which the gRNA hybridizes to, or the strand complementary to the strand the gRNA hybridizes with. In an embodiment, an eaCas9 molecule or eaCas9 polypeptide comprises cleavage activity associated with an HNH domain. In an embodiment, an eaCas9 molecule or eaCas9 polypeptide comprises cleavage activity associated with a RuvC domain. In an embodiment, an eaCas9 molecule or eaCas9 polypeptide comprises cleavage activity associated with an HNH domain and cleavage activity associated with a RuvC domain. In an embodiment, an eaCas9 molecule or eaCas9 polypeptide comprises an active, or cleavage competent, HNH domain and an inactive, or cleavage incompetent, RuvC domain. In an embodiment, an eaCas9 molecule or eaCas9 polypeptide comprises an inactive, or cleavage incompetent, HNH domain and an active, or cleavage competent, RuvC domain.

Targeting and PAMs

A Cas9 molecule or Cas9 polypeptide can interact with a gRNA molecule and, in concert with the gRNA molecule, localizes to a site which comprises a target domain, and in certain embodiments, a PAM sequence. In some embodiments, the Cas9 molecule or Cas9 polypeptide is a Cas9 nickase. In certain embodiments, at least two Cas9 nickases, e.g., paired nickases, are used. In other embodiments, the at least two Cas9 nickases interact with at least two gRNA molecules.

In certain embodiments, the ability of an eaCas9 molecule or eaCas9 polypeptide to interact with and cleave a target nucleic acid is PAM sequence dependent. A PAM sequence is a sequence in the target nucleic acid. In an embodiment, cleavage of the target nucleic acid occurs upstream from the PAM sequence. eaCas9 molecules from different bacterial species can recognize different sequence motifs (e.g., PAM sequences). In an embodiment, an eaCas9 molecule of S. pyogenes recognizes the sequence motif NGG and directs cleavage of a target nucleic acid sequence 1 to 10, e.g., 3 to 5, bp upstream from that sequence (see, e.g., Mali et al., SCIENCE 2013; 339(6121): 823-826.). In an embodiment, an eaCas9 molecule of S. thermophilus recognizes the sequence motif NGGNG (SEQ ID NO: 199) and/or NNAGAAW (W=A or T) (SEQ ID NO:200), wherein N is any nucleotide, and directs cleavage of a target nucleic acid sequence 1 to 10, e.g., 3 to 5, bp upstream from these sequences (see, e.g., Horvath et al., SCIENCE 2010; 327(5962):167-170, and Deveau et al., J BACTERIOL 2008; 190(4): 1390-1400). In an embodiment, an eaCas9 molecule of S. mutans recognizes the sequence motif NGG and/or NAAR (R=A or G) (SEQ ID NO:201) and directs cleavage of a target nucleic acid sequence 1 to 10, e.g., 3 to 5 bp, upstream from this sequence (see, e.g., Deveau et al., J BACTERIOL 2008; 190(4): 1390-1400). In an embodiment, an eaCas9 molecule of S. aureus recognizes the sequence motif NNGRR (R=A or G) (SEQ ID NO:202) and directs cleavage of a target nucleic acid sequence 1 to 10, e.g., 3 to 5, bp upstream from that sequence. In an embodiment, an eaCas9 molecule of S. aureus recognizes the sequence motif NNGRRN (R=A or G) (SEQ ID NO:203) and directs cleavage of a target nucleic acid sequence 1 to 10, e.g., 3 to 5, bp upstream from that sequence. In an embodiment, an eaCas9 molecule of S. aureus recognizes the sequence motif NNGRRT (R=A or G) (SEQ ID NO:204) and directs cleavage of a target nucleic acid sequence 1 to 10, e.g., 3 to 5, bp upstream from that sequence. In an embodiment, an eaCas9 molecule of S. aureus recognizes the sequence motif NNGRRV (R=A or G) (SEQ ID NO:205) and directs cleavage of a target nucleic acid sequence 1 to 10, e.g., 3 to 5, bp upstream from that sequence. The ability of a Cas9 molecule to recognize a PAM sequence can be determined, e.g., using a transformation assay as described previously (see Jinek et al., SCIENCE 2012, 337:816). In the aforementioned embodiments, N can be any nucleotide residue, e.g., any of A, G, C, or T.

Each PAM may be oriented in order to affect repair outcome based on the ability of the eaCas9 molecule to direct cleavage of a target nucleic acid sequence 1 to 10, e.g., 3 to 5, bp upstream from the PAM sequence. In some embodiments, the two PAM sequences recognized by the two Cas9 nickases are facing inward, directly adjacent to the spacer sequence (the "PAM-in" orientation). In other embodiments, the two PAM sequences recognized by the two Cas9 nickases are facing outward, or positioned at the outer boundaries of the full-length target site (the "PAM-out" orientation).

As is discussed herein, Cas9 molecules can be engineered to alter the PAM specificity of the Cas9 molecule.

Exemplary naturally occurring Cas9 molecules have been described previously (see, e.g., Chylinski 2013). Such Cas9 molecules include Cas9 molecules of a cluster 1 bacterial family, cluster 2 bacterial family, cluster 3 bacterial family, cluster 4 bacterial family, cluster 5 bacterial family, cluster 6 bacterial family, a cluster 7 bacterial family, a cluster 8 bacterial family, a cluster 9 bacterial family, a cluster 10 bacterial family, a cluster 11 bacterial family, a cluster 12 bacterial family, a cluster 13 bacterial family, a cluster 14 bacterial family, a cluster 15 bacterial family, a cluster 16 bacterial family, a cluster 17 bacterial family, a cluster 18 bacterial family, a cluster 19 bacterial family, a cluster 20 bacterial family, a cluster 21 bacterial family, a cluster 22 bacterial family, a cluster 23 bacterial family, a cluster 24 bacterial family, a cluster 25 bacterial family, a cluster 26 bacterial family, a cluster 27 bacterial family, a cluster 28 bacterial family, a cluster 29 bacterial family, a cluster 30 bacterial family, a cluster 31 bacterial family, a cluster 32 bacterial family, a cluster 33 bacterial family, a cluster 34 bacterial family, a cluster 35 bacterial family, a cluster 36 bacterial family, a cluster 37 bacterial family, a cluster 38 bacterial family, a cluster 39 bacterial family, a cluster 40 bacterial family, a cluster 41 bacterial family, a cluster 42 bacterial family, a cluster 43 bacterial family, a cluster 44 bacterial family, a cluster 45 bacterial family, a cluster 46 bacterial family, a cluster 47 bacterial family, a cluster 48 bacterial family, a cluster 49 bacterial family, a cluster 50 bacterial family, a cluster 51 bacterial family, a cluster 52 bacterial family, a cluster 53 bacterial family, a cluster 54 bacterial family, a cluster 55 bacterial family, a cluster 56 bacterial family, a cluster 57 bacterial family, a cluster 58 bacterial family, a cluster 59 bacterial family, a cluster 60 bacterial family, a cluster 61 bacterial family, a cluster 62 bacterial family, a cluster 63 bacterial family, a cluster 64 bacterial family, a cluster 65 bacterial family, a cluster 66 bacterial family, a cluster 67 bacterial family, a cluster 68 bacterial family, a cluster 69 bacterial family, a cluster 70 bacterial family, a cluster 71 bacterial family, a cluster 72 bacterial family, a cluster 73 bacterial family, a cluster 74 bacterial family, a cluster 75 bacterial family, a cluster 76 bacterial family, a cluster 77 bacterial family, or a cluster 78 bacterial family.

Exemplary naturally occurring Cas9 molecules include a Cas9 molecule of a cluster 1 bacterial family. Examples include a Cas9 molecule of: *S. aureus*, *S. pyogenes* (e.g., strain SF370, MGAS10270, MGAS10750, MGAS2096, MGAS315, MGAS5005, MGAS6180, MGAS9429, NZ131 and SSI-1), *S. thermophilus* (e.g., strain LMD-9), *S. pseudoporcinus* (e.g., strain SPIN 20026), *S. mutans* (e.g., strain UA159, NN2025), *S. macacae* (e.g., strain NCTC11558), *S. gallolyticus* (e.g., strain UCN34, ATCC BAA-2069), *S. equines* (e.g., strain ATCC 9812, MGCS 124), *S. dysdalactiae* (e.g., strain GGS 124), *S. bovis* (e.g., strain ATCC 700338), *S. anginosus* (e.g., strain F0211), *S. agalactiae* (e.g., strain NEM316, A909), *Listeria monocytogenes* (e.g., strain F6854), *Listeria innocua* (*L. innocua*, e.g., strain Clip11262), *Enterococcus italicus* (e.g., strain DSM 15952), or *Enterococcus faecium* (e.g., strain 1,231,408).

In certain embodiments, a Cas9 molecule or Cas9 polypeptide comprises an amino acid sequence:
having 60%, 65%, 70%, 75%, 80%, 85%, 90%, 95%, 96%, 97%, 98% or 99% homology with;
differs at no more than, 2, 5, 10, 15, 20, 30, or 40% of the amino acid residues when compared with;
differs by at least 1, 2, 5, 10 or 20 amino acids, but by no more than 100, 80, 70, 60, 50, 40 or 30 amino acids from; or
identical to any Cas9 molecule sequence described herein, or to a naturally occurring Cas9 molecule sequence, e.g., a Cas9 molecule from a species listed herein (e.g., SEQ ID NOs:1, 2, 4-6, or 12) or described in Chylinski 2013. In an embodiment, the Cas9 molecule or Cas9 polypeptide comprises one or more of the following activities: a nickase activity; a double stranded cleavage activity (e.g., an endonuclease and/or exonuclease activity); a helicase activity; or the ability, together with a gRNA molecule, to localize to a target nucleic acid.

A comparison of the sequence of a number of Cas9 molecules indicate that certain regions are conserved. These are identified below as:
region 1 (residues 1 to 180, or in the case of region 1', residues 120 to 180)
region 2 (residues 360 to 480);
region 3 (residues 660 to 720);
region 4 (residues 817 to 900); and
region 5 (residues 900 to 960).

In an embodiment, a Cas9 molecule or Cas9 polypeptide comprises regions 1-5, together with sufficient additional Cas9 molecule sequence to provide a biologically active molecule, e.g., a Cas9 molecule having at least one activity described herein. In an embodiment, each of regions 1-5, independently, have 50%, 60%, 70%, 80%, 85%, 90%, 95%, 96%, 97%, 98% or 99% homology with the corresponding residues of a Cas9 molecule or Cas9 polypeptide described herein.

In an embodiment, a Cas9 molecule or Cas9 polypeptide comprises an amino acid sequence referred to as region 1:
having 50%, 60%, 70%, 80%, 85%, 90%, 95%, 96%, 97%, 98% or 99% homology with amino acids 1-180 of the amino acid sequence of Cas9 of *S. pyogenes;*
differs by at least 1, 2, 5, 10 or 20 amino acids but by no more than 90, 80, 70, 60, 50, 40 or 30 amino acids from amino acids 1-180 of the amino acid sequence of Cas9 of *S. pyogenes, S. thermophilus, S. mutans*, or *Listeria innocua*; or
is identical to amino acids 1-180 of the amino acid sequence of Cas9 of *S. pyogenes, S. thermophilus, S. mutans*, or *L. innocua*.

In an embodiment, a Cas9 molecule or Cas9 polypeptide comprises an amino acid sequence referred to as region 1':
having 55%, 60%, 65%, 70%, 75%, 80%, 85%, 90%, 95%, 96%, 97%, 98% or 99% homology with amino acids 120-180 of the amino acid sequence of Cas9 of *S. pyogenes, S. thermophilus, S. mutans* or *L. innocua;*
differs by at least 1, 2, or 5 amino acids but by no more than 35, 30, 25, 20 or 10 amino acids from amino acids 120-180 of the amino acid sequence of Cas9 of *S. pyogenes, S. thermophilus, S. mutans*, or *L. innocua*; or
is identical to amino acids 120-180 of the amino acid sequence of Cas9 of *S. pyogenes, S. thermophilus, S. mutans*, or *L. innocua*.

In an embodiment, a Cas9 molecule or Cas9 polypeptide comprises an amino acid sequence referred to as region 2:
having 50%, 55%, 60%, 65%, 70%, 75%, 80%, 85%, 90%, 95%, 96%, 97%, 98% or 99% homology with amino acids 360-480 of the amino acid sequence of Cas9 of *S. pyogenes, S. thermophilus, S. mutans*, or *L. innocua;*
differs by at least 1, 2, or 5 amino acids but by no more than 35, 30, 25, 20 or 10 amino acids from amino acids 360-480 of the amino acid sequence of Cas9 of *S. pyogenes, S. thermophilus, S. mutans*, or *L. innocua*; or
is identical to amino acids 360-480 of the amino acid sequence of Cas9 of *S. pyogenes, S. thermophilus, S. mutans*, or *L. innocua*.

In certain embodiments, a Cas9 molecule or Cas9 polypeptide comprises an amino acid sequence referred to as region 3:

having 55%, 60%, 65%, 70%, 75%, 80%, 85%, 90%, 95%, 96%, 97%, 98%, or 99% homology with amino acids 660-720 of the amino acid sequence of Cas9 of *S. pyogenes, S. thermophilus, S. mutans* or *L. innocua;* differs by at least 1, 2, or 5 amino acids but by no more than 35, 30, 25, 20 or 10 amino acids from amino acids 660-720 of the amino acid sequence of Cas9 of *S. pyogenes, S. thermophilus, S. mutans* or *L. innocua;* or is identical to amino acids 660-720 of the amino acid sequence of Cas9 of *S. pyogenes, S. thermophilus, S. mutans* or *L. innocua.*

In an embodiment, a Cas9 molecule or Cas9 polypeptide comprises an amino acid sequence referred to as region 4:

having 50%, 55%, 60%, 65%, 70%, 75%, 80%, 85%, 90%, 95%, 96%, 97%, 98%, or 99% homology with amino acids 817-900 of the amino acid sequence of Cas9 of *S. pyogenes, S. thermophilus, S. mutans,* or *L. innocua;* differs by at least 1, 2, or 5 amino acids but by no more than 35, 30, 25, 20 or 10 amino acids from amino acids 817-900 of the amino acid sequence of Cas9 of *S. pyogenes, S. thermophilus, S. mutans,* or *L. innocua;* or is identical to amino acids 817-900 of the amino acid sequence of Cas9 of *S. pyogenes, S. thermophilus, S. mutans,* or *L. innocua.*

In an embodiment, a Cas9 molecule or Cas9 polypeptide comprises an amino acid sequence referred to as region 5:

having 50%, 55%, 60%, 65%, 70%, 75%, 80%, 85%, 90%, 95%, 96%, 97%, 98%, or 99% homology with amino acids 900-960 of the amino acid sequence of Cas9 of *S. pyogenes, S. thermophilus, S. mutans,* or *L. innocua;* differs by at least 1, 2, or 5 amino acids but by no more than 35, 30, 25, 20 or 10 amino acids from amino acids 900-960 of the amino acid sequence of Cas9 of *S. pyogenes, S. thermophilus, S. mutans,* or *L. innocua;* or is identical to amino acids 900-960 of the amino acid sequence of Cas9 of *S. pyogenes, S. thermophilus, S. mutans,* or *L. innocua.*

Engineered or Altered Cas9

Cas9 molecules and Cas9 polypeptides described herein can possess any of a number of properties, including nuclease activity (e.g., endonuclease and/or exonuclease activity); helicase activity; the ability to associate functionally with a gRNA molecule; and the ability to target (or localize to) a site on a nucleic acid (e.g., PAM recognition and specificity). In certain embodiments, a Cas9 molecule or Cas9 polypeptide can include all or a subset of these properties. In a typical embodiment, a Cas9 molecule or Cas9 polypeptide has the ability to interact with a gRNA molecule and, in concert with the gRNA molecule, localize to a site in a nucleic acid. Other activities, e.g., PAM specificity, cleavage activity, or helicase activity can vary more widely in Cas9 molecules and Cas9 polypeptides.

Cas9 molecules include engineered Cas9 molecules and engineered Cas9 polypeptides (engineered, as used in this context, means merely that the Cas9 molecule or Cas9 polypeptide differs from a reference sequences, and implies no process or origin limitation). An engineered Cas9 molecule or Cas9 polypeptide can comprise altered enzymatic properties, e.g., altered nuclease activity, (as compared with a naturally occurring or other reference Cas9 molecule) or altered helicase activity. As discussed herein, an engineered Cas9 molecule or Cas9 polypeptide can have nickase activity (as opposed to double strand nuclease activity). In an embodiment an engineered Cas9 molecule or Cas9 polypeptide can have an alteration that alters its size, e.g., a deletion of amino acid sequence that reduces its size, e.g., without significant effect on one or more, or any Cas9 activity. In an embodiment, an engineered Cas9 molecule or Cas9 polypeptide can comprise an alteration that affects PAM recognition. For example, an engineered Cas9 molecule can be altered to recognize a PAM sequence other than that recognized by the endogenous wild-type PI domain. In an embodiment a Cas9 molecule or Cas9 polypeptide can differ in sequence from a naturally occurring Cas9 molecule but not have significant alteration in one or more Cas9 activities.

Cas9 molecules or Cas9 polypeptides with desired properties can be made in a number of ways, e.g., by alteration of a parental, e.g., naturally occurring, Cas9 molecules or Cas9 polypeptides, to provide an altered Cas9 molecule or Cas9 polypeptide having a desired property. For example, one or more mutations or differences relative to a parental Cas9 molecule, e.g., a naturally occurring or engineered Cas9 molecule, can be introduced. Such mutations and differences comprise: substitutions (e.g., conservative substitutions or substitutions of non-essential amino acids); insertions; or deletions. In an embodiment, a Cas9 molecule or Cas9 polypeptide can comprises one or more mutations or differences, e.g., at least 1, 2, 3, 4, 5, 6, 7, 8, 9, 10, 15, 20, 30, 40 or 50 mutations but less than 200, 100, or 80 mutations relative to a reference, e.g., a parental, Cas9 molecule.

In certain embodiments, a mutation or mutations do not have a substantial effect on a Cas9 activity, e.g. a Cas9 activity described herein. In other embodiments, a mutation or mutations have a substantial effect on a Cas9 activity, e.g. a Cas9 activity described herein.

Non-Cleaving and Modified-Cleavage Cas9

In an embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from naturally occurring Cas9 molecules, e.g., a Cas9 molecule of *S. pyogenes,* as follows: its ability to modulate, e.g., decreased or increased, cleavage of a double stranded nucleic acid (endonuclease and/or exonuclease activity), e.g., as compared to a naturally occurring Cas9 molecule (e.g., a Cas9 molecule of *S. pyogenes*); its ability to modulate, e.g., decreased or increased, cleavage of a single strand of a nucleic acid, e.g., a non-complementary strand of a nucleic acid molecule or a complementary strand of a nucleic acid molecule (nickase activity), e.g., as compared to a naturally occurring Cas9 molecule (e.g., a Cas9 molecule of *S. pyogenes*); or the ability to cleave a nucleic acid molecule, e.g., a double stranded or single stranded nucleic acid molecule, can be eliminated.

In certain embodiments, an eaCas9 molecule or eaCas9 polypeptide comprises one or more of the following activities: cleavage activity associated with an N-terminal RuvC-like domain; cleavage activity associated with an HNH-like domain; cleavage activity associated with an HNH-like domain and cleavage activity associated with an N-terminal RuvC-like domain.

In certain embodiments, an eaCas9 molecule or eaCas9 polypeptide comprises an active, or cleavage competent, HNH-like domain (e.g., an HNH-like domain described herein, e.g., SEQ ID NOs:24-28) and an inactive, or cleavage incompetent, N-terminal RuvC-like domain. An exemplary inactive, or cleavage incompetent N-terminal RuvC-like domain can have a mutation of an aspartic acid in an N-terminal RuvC-like domain, e.g., an aspartic acid at position 10 of SEQ ID NO:2, e.g., can be substituted with an alanine. In an embodiment, the eaCas9 molecule or eaCas9 polypeptide differs from wild-type in the N-terminal RuvC-like domain and does not cleave the target nucleic acid, or cleaves with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of S. pyogenes, S. aureus, or S. thermophilus. In an embodiment, the reference Cas9 molecule is the naturally occurring Cas9 molecule having the closest sequence identity or homology.

In an embodiment, an eaCas9 molecule or eaCas9 polypeptide comprises an inactive, or cleavage incompetent, HNH domain and an active, or cleavage competent, N-terminal RuvC-like domain (e.g., a RuvC-like domain described herein, e.g., SEQ ID NOs:15-23). Exemplary inactive, or cleavage incompetent HNH-like domains can have a mutation at one or more of: a histidine in an HNH-like domain, e.g., can be substituted with an alanine; and one or more asparagines in an HNH-like domain, e.g., can be substituted with an alanine. In an embodiment, the eaCas9 differs from wild-type in the HNH-like domain and does not cleave the target nucleic acid, or cleaves with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of S. pyogenes, S. aureus, or S. thermophilus. In an embodiment, the reference Cas9 molecule is the naturally occurring Cas9 molecule having the closest sequence identity or homology.

In certain embodiments, exemplary Cas9 activities comprise one or more of PAM specificity, cleavage activity, and helicase activity. A mutation(s) can be present, e.g., in: one or more RuvC domains, e.g., an N-terminal RuvC domain; an HNH domain; a region outside the RuvC domains and the HNH domain. In an embodiment, a mutation(s) is present in a RuvC domain. In an embodiment, a mutation(s) is present in an HNH domain. In an embodiment, mutations are present in both a RuvC domain and an HNH domain.

Exemplary mutations that may be made in the RuvC domain or HNH domain with reference to the S. pyogenes Cas9 sequence include: D10A, E762A, H840A, N854A, N863A and/or D986A. Exemplary mutations that may be made in the RuvC domain with reference to the S. aureus Cas9 sequence include N580A (see, e.g., SEQ ID NO:11). In an embodiment, a Cas9 molecule is an eiCas9 molecule comprising one or more differences in a RuvC domain and/or in an HNH domain as compared to a reference Cas9 molecule, and the eiCas9 molecule does not cleave a nucleic acid, or cleaves with significantly less efficiency than does wildtype, e.g., when compared with wild type in a cleavage assay, e.g., as described herein, cuts with less than 50, 25, 20, 19, 18, 17, 16, 15, 14, 13, 12, 11, 10, 9, 8, 7, 6, 5, 4, 3, 2, or 1% of a reference Cas9 molecule, as measured by an assay described herein.

Whether or not a particular sequence, e.g., a substitution, may affect one or more activity, such as targeting activity, cleavage activity, etc., can be evaluated or predicted, e.g., by evaluating whether the mutation is conservative. In an embodiment, a "non-essential" amino acid residue, as used in the context of a Cas9 molecule, is a residue that can be altered from the wild-type sequence of a Cas9 molecule, e.g., a naturally occurring Cas9 molecule, e.g., an eaCas9 molecule, without abolishing or more preferably, without substantially altering a Cas9 activity (e.g., cleavage activity), whereas changing an "essential" amino acid residue results in a substantial loss of activity (e.g., cleavage activity).

In an embodiment, a Cas9 molecule comprises a cleavage property that differs from naturally occurring Cas9 molecules, e.g., that differs from the naturally occurring Cas9 molecule having the closest homology. For example, a Cas9 molecule can differ from naturally occurring Cas9 molecules, e.g., a Cas9 molecule of S aureus or S. pyogenes, as follows: its ability to modulate, e.g., decreased or increased, cleavage of a double stranded break (endonuclease and/or exonuclease activity), e.g., as compared to a naturally occurring Cas9 molecule (e.g., a Cas9 molecule of S aureus or S. pyogenes); its ability to modulate, e.g., decreased or increased, cleavage of a single strand of a nucleic acid, e.g., a non-complimentary strand of a nucleic acid molecule or a complementary strand of a nucleic acid molecule (nickase activity), e.g., as compared to a naturally occurring Cas9 molecule (e.g., a Cas9 molecule of S aureus or S. pyogenes); or the ability to cleave a nucleic acid molecule, e.g., a double stranded or single stranded nucleic acid molecule, can be eliminated. In certain embodiments, the nickase is S. aureus Cas9-derived nickase comprising the sequence of SEQ ID NO:10 (D10A) or SEQ ID NO:11 (N580A) (Friedland 2015).

In an embodiment, the altered Cas9 molecule is an eaCas9 molecule comprising one or more of the following activities: cleavage activity associated with a RuvC domain; cleavage activity associated with an HNH domain; cleavage activity associated with an HNH domain and cleavage activity associated with a RuvC domain.

In certain embodiments, the altered Cas9 molecule or Cas9 polypeptide, e.g., an eaCas9 molecule or eaCas9 polypeptide, can be a fusion, e.g., of two of more different Cas9 molecules, e.g., of two or more naturally occurring Cas9 molecules of different species. For example, a fragment of a naturally occurring Cas9 molecule of one species can be fused to a fragment of a Cas9 molecule of a second species. As an example, a fragment of a Cas9 molecule of S. pyogenes comprising an N-terminal RuvC-like domain can be fused to a fragment of Cas9 molecule of a species other than S. pyogenes (e.g., S. thermophilus) comprising an HNH-like domain.

Cas9 with Altered or No PAM Recognition

Naturally occurring Cas9 molecules can recognize specific PAM sequences, for example the PAM recognition sequences described above for, e.g., S. pyogenes, S. thermophilus, S. mutans, and S. aureus.

In certain embodiments, a Cas9 molecule or Cas9 polypeptide has the same PAM specificities as a naturally occurring Cas9 molecule. In other embodiments, a Cas9 molecule or Cas9 polypeptide has a PAM specificity not associated with a naturally occurring Cas9 molecule, or a PAM specificity not associated with the naturally occurring Cas9 molecule to which it has the closest sequence homology. For example, a naturally occurring Cas9 molecule can be altered, e.g., to alter PAM recognition, e.g., to alter the PAM sequence that the Cas9 molecule or Cas9 polypeptide recognizes in order to decrease off-target sites and/or improve specificity; or eliminate a PAM recognition requirement. In certain embodiments, a Cas9 molecule or Cas9 polypeptide can be altered, e.g., to increase length of PAM recognition sequence and/or improve Cas9 specificity to high level of identity (e.g., 98%, 99% or 100% match between gRNA and a PAM sequence), e.g., to decrease off-target sites and/or increase specificity. In certain embodiments, the length of the PAM recognition sequence is at least 4, 5, 6, 7, 8, 9, 10 or 15 amino acids in length. In an embodiment, the Cas9 specificity requires at least 90%, 95%, 96%, 97%, 98%, 99% or more homology between the gRNA and the PAM sequence. Cas9 molecules or Cas9 polypeptides that recognize different PAM sequences and/or have reduced off-target activity can be generated using directed evolution. Exemplary methods and systems that can be used for directed evolution of Cas9 molecules are described (see, e.g., Esvelt 2011). Candidate Cas9 molecules can be evaluated, e.g., by methods described below.

Size-Optimized Cas9

Engineered Cas9 molecules and engineered Cas9 polypeptides described herein include a Cas9 molecule or Cas9 polypeptide comprising a deletion that reduces the size of the molecule while still retaining desired Cas9 properties, e.g., essentially native conformation, Cas9 nuclease activity, and/or target nucleic acid molecule recognition. Provided herein are Cas9 molecules or Cas9 polypeptides comprising one or more deletions and optionally one or more linkers, wherein a linker is disposed between the amino acid residues that flank the deletion. Methods for identifying suitable deletions in a reference Cas9 molecule, methods for generating Cas9 molecules with a deletion and a linker, and methods for using such Cas9 molecules will be apparent to one of ordinary skill in the art upon review of this document.

A Cas9 molecule, e.g., a S. aureus or S. pyogenes Cas9 molecule, having a deletion is smaller, e.g., has reduced number of amino acids, than the corresponding naturally-occurring Cas9 molecule. The smaller size of the Cas9 molecules allows increased flexibility for delivery methods, and thereby increases utility for genome-editing. A Cas9 molecule can comprise one or more deletions that do not substantially affect or decrease the activity of the resultant Cas9 molecules described herein. Activities that are retained in the Cas9 molecules comprising a deletion as described herein include one or more of the following:

a nickase activity, i.e., the ability to cleave a single strand, e.g., the non-complementary strand or the complementary strand, of a nucleic acid molecule; a double stranded nuclease activity, i.e., the ability to cleave both strands of a double stranded nucleic acid and create a double stranded break, which in an embodiment is the presence of two nickase activities;

an endonuclease activity;

an exonuclease activity;

a helicase activity, i.e., the ability to unwind the helical structure of a double stranded nucleic acid;

and recognition activity of a nucleic acid molecule, e.g., a target nucleic acid or a gRNA.

Activity of the Cas9 molecules described herein can be assessed using the activity assays described herein or in the art.

Identifying Regions Suitable for Deletion

Suitable regions of Cas9 molecules for deletion can be identified by a variety of methods. Naturally-occurring orthologous Cas9 molecules from various bacterial species can be modeled onto the crystal structure of S. pyogenes Cas9 (Nishimasu et al., CELL, 156:935-949, 2014) to examine the level of conservation across the selected Cas9 orthologs with respect to the three-dimensional conformation of the protein. Less conserved or unconserved regions that are spatially located distant from regions involved in Cas9 activity, e.g., interface with the target nucleic acid molecule and/or gRNA, represent regions or domains are candidates for deletion without substantially affecting or decreasing Cas9 activity.

Nucleic Acids Encoding Cas9 Polypeptides

Nucleic acids encoding the Cas9 polypeptides, e.g., an eaCas9 molecule or eaCas9 polypeptides are provided herein. Exemplary nucleic acids encoding Cas9 molecules or Cas9 polypeptides have been described previously (see, e.g., Cong et al. (2013) SCIENCE 399(6121): 819-823; Wang et al. (2013) CELL 153(4): 910-918; Mali et al. SCIENCE 399(6121): 823-826 (2013); Jinek et al. (2012) SCIENCE 337(6096):816-821).

In an embodiment, a nucleic acid encoding a Cas9 molecule or Cas9 polypeptide can be a synthetic nucleic acid sequence. For example, the synthetic nucleic acid molecule can be chemically modified, e.g., as described herein. In an embodiment, the Cas9 mRNA has one or more (e.g., all of the following properties: it is capped, polyadenylated, substituted with 5-methylcytidine and/or pseudouridine.

In addition, or alternatively, the synthetic nucleic acid sequence can be codon optimized, e.g., at least one non-common codon or less-common codon has been replaced by a common codon. For example, the synthetic nucleic acid can direct the synthesis of an optimized messenger mRNA, e.g., optimized for expression in a mammalian expression system, e.g., described herein.

In addition, or alternatively, a nucleic acid encoding a Cas9 molecule or Cas9 polypeptide may comprise a nuclear localization sequence (NLS). Nuclear localization sequences are known in the art.

An exemplary codon optimized nucleic acid sequence encoding a Cas9 molecule of S. pyogenes is set forth in SEQ ID NO:3. The corresponding amino acid sequence of an S. pyogenes Cas9 molecule is set forth in SEQ ID NO:2.

Exemplary codon optimized nucleic acid sequences encoding a Cas9 molecule of S. aureus are set forth in SEQ ID NOs:7-9. An amino acid sequence of an S. aureus Cas9 molecule is set forth in SEQ ID NO:6.

If any of the above Cas9 sequences are fused with a peptide or polypeptide at the C-terminus, it is understood that the stop codon will be removed.

Exonucleases

Three prime repair exonuclease 2 (Trex2) is a non-processive 3' to 5' exonuclease (see, e.g., Mazur and Perrino, J BIOL CHEM, 274: 19655-60, 1999). Trex2 may also interact with DNA polymerase delta to confer exonuclease capability. A Trex2 molecule refers to Trex2 polypeptides and Trex2 nucleic acids, e.g., SEQ ID NO: 255 or SEQ ID NO:256, and to engineered, altered, or modified Trex2 polypeptides or Trex2 nucleic acids, or fragments thereof, that differ, e.g., by at least one amino acid residue, from a reference sequence, e.g., SEQ ID NO: 255 or SEQ ID NO:256, but which retain 3' exonuclease activity.

The methods described herein are directed to the use of a Trex2 molecule, e.g., an endogenous or a heterologous Trex2 molecule, in combination with at least one Cas9 molecule and two gRNA molecules in order to generate precise deletions in a target nucleic acid. Thus, using the methods and compositions described herein, it is now possible to generate a precise deletion in a target nucleic acid sequence of interest, e.g., a nucleic acid sequence comprising an undesired nucleic acid sequence (for instance, a point mutation, insertion or deletion), e.g., linked to a disease, following a Cas9 molecule-mediated cleavage event. While not wishing to be bound by theory, it is believed that by contacting a cell with a Cas9 system comprising one or more gRNA molecules that are designed to associate with a target nucleic acid, an eaCas9 nickase molecule, and a Trex2 molecule, a double strand break can be generated in the target nucleic acid having a first 3' overhang and a second 3' overhang which are then processed by the Trex2 molecule to produce a processed double strand break. The processed double strand break is then resolved by the cell's DNA repair mechanisms to generate a precise deletion in the target nucleic acid.

In an embodiment, the Trex2 molecule comprises at least 60, 70, 80, 81, 82, 83, 84, 85, 86, 87, 88, 89, 90, 91, 92, 93, 94, 95, 96, 97, 98, 99 or 100% homology with, or differs by no more than 50, 40, 30, 20, 19, 18, 17, 16, 15, 14, 13, 12, 11, 10, 9, 8, 7, 6, 5, 4, 3, 2, or 1, amino acid residues from, a naturally occurring Trex2 molecule, e.g., as disclosed herein. Also encompassed herein are the various isoforms, transcription and splice variants of the naturally occurring Trex2.

In an embodiment, the Trex2 molecule comprises a functional fragment of a naturally occurring Trex2 molecule disclosed herein, e.g., SEQ ID NO: 255 or SEQ ID NO:256. In an embodiment, the functional fragment comprises at least 5, 10, 15, 20, 25, 30, 35, 40, 45, 50, 55, 60, 65, 70, 75, 80, 81, 82, 83, 84, 85, 86, 87, 88, 89, 90, 91, 92, 93, 94, 95, 96, 97, 98, or 99% of the amino acid residues of a naturally occurring Trex2 molecule. For example, the Trex2 molecule can be a domain or a functional fragment of a domain of a naturally occurring Trex2 molecule, e.g., the domain or functional fragment may comprise exonuclease activity. Functional activity of a domain or fragment of a naturally occurring Trex2 molecule described herein can be tested using functional assays for exonuclease activity known in the art and described in more detail, below.

In an embodiment, the methods disclosed herein comprise increasing the protein level of a Trex2 molecule in a cell, as compared to the level of expression of the endogenous Trex2 protein in a cell, by at least 0.5-fold, e.g., 0.5-fold, 1-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 50-fold, or more. In an embodiment, the methods disclosed herein comprise increasing the protein level of a Trex2 molecule in a cell, as compared to the endogenous Trex2 protein level in a cell, by at least 10%, e.g., 10, 20, 30, 40, 50, 60, 70, 80, 90, 100, 150, 200, 250, 300, 400, 500, 600, 700, 800, 900, 1000, 1100, 1200, 1300, 1400, 1500, 1600, 1700, 1800, 1900, 2000, 2500, 3000, 4000, 5000% or more.

In an embodiment, the protein levels of endogenous Trex2 molecule in a cell are increased by methods known in the art. For example, a cell can be modified and/or treated to: (a) increase the transcription of a gene encoding endogenous Trex2; (b) increase the translation and/or processing and/or stability of endogenous Trex2 mRNA; (c) increase the stability of endogenous Trex2 protein; (d) increase the expression of, or activate, transcriptional activators of a gene encoding endogenous Trex2; (e) to decrease the expression, or activity, of a transcriptional repressors of a gene encoding endogenous Trex2 or (f) to decrease the expression, or activity, of a post-translational repressor of the Trex2 protein.

In other embodiments, a heterologous Trex2 molecule is overexpressed in a cell.

The nucleotide and amino acid sequences of an exemplary Trex2 molecule are provided in Table 1.

TABLE 1

Trex2 Exonuclease Amino Acid and Nucleotide Sequences

| Name | Activity | Sequence | SEQ ID NO: |
|---|---|---|---|
| Trex2 CCDS 35437.1 (amino acid sequence) | 3' to 5' exonuclease activity | MSEAPRAETFVFLDLEATGLPSVEPEIAELSLFAVHRSSLENPEHDESG ALVLPRVLDKLTLCMCPERPFTAKASEITGLSSEGLARCRKAGFDGAVV RTLQAFLSRQAGPICLVAHNGFDYDFPLLCAELRRLGARLPRDTVCLDT LPALRGLDRAHSHGTRARGRQGYSLGSLFHRYFRAEPSAAHSAEGDVHT LLLIFLHRAAELLAWADEQARGWAHIEPMYLPPDDPSLEA | 255 |
| Trex2 CCDS 35437.1 (nucleotide sequence) | 3' to 5' exonuclease activity | ATGTCCGAGGCACCCCGGGCCGAGACCTTTGTCTTCCTGGACCTGGAAG CCACTGGGCTCCCCAGTGTGGAGCCCGAGATTGCCGAGCTGTCCCTCTT TGCTGTCCACCGCTCCTCCCTGGAGAACCCGGAGCACGACGAGTCTGGT GCCCTAGTATTGCCCCGGGTCCTGGACAAGCTCACGCTGTGCATGTGCC CGGAGCGCCCCTTCACTGCCAAGGCCAGCGAGATCACCGGCCTGAGCAG TGAGGGCCTGGCGCGATGCCGGAAGGCTGGCTTTGATGGCGCCGTGGTG CGGACGCTGCAGGCCTTCCTGAGCCGCCAGGCAGGGCCCATCTGCCTTG TGGCCCACAATGGCTTTGATTATGATTTCCCCCTGCTGTGTGCCGAGCT GCGGCGCCTGGGTGCCCGCCTGCCCCGGGACACTGTCTGCCTGGACACG CTGCCGGCCCTGCGGGGCCTGGACCGCGCCCACAGCCACGGCACCCGGG CCCGGGGCCGCCAGGGTTACAGCCTCGGCAGCCTCTTCCACCGCTACTT CCGGGCAGAGCCAAGCGCAGCCCACTCAGCCGAGGGCGACGTGCACACC CTGCTCCTGATCTTCCTGCACCGCGCCGCAGAGCTGCTCGCCTGGGCCG ATGAGCAGGCCCGTGGGTGGGCCCACATCGAGCCCATGTACTTGCCGCC TGATGACCCCAGCCTGGAGGCCTGA | 256 |

In one embodiment, and without wishing to be bound by theory, it is believed that the use of a Trex2 molecule in combination with a Cas9 molecule and a gRNA molecule can modulate the DNA repair pathways that a cell utilizes to resolve or repair a Cas9-mediated cleavage event. Thus, a Cas9 molecule and at least one gRNA molecule, in combination with a Trex2 molecule, can be used in the methods described herein to modulate the frequency by which a cell or a population of cells resolves or repairs a Cas9-mediated cleavage event using one or more of the following DNA repair pathways: resection, mismatch repair (MMR), nucleotide excision repair (NER), base excision repair (BER), canonical non-homologous end joining (canonical NHEJ), alternative non-homologous end joining (ALT-NHEJ), canonical homology directed-repair (canonical HDR), alternative homology directed repair (ALT-HDR), microhomology-mediated end joining (MMEJ), single strand annealing (SSA), Holliday junction model or double strand break repair (DSBR), synthesis-dependent strand annealing (SDSA), single strand break repair (SSBR), translesion synthesis repair (TLS), and interstrand crosslink repair (ICL).

Nucleic Acids Encoding Trex2 Molecules

Nucleic acids encoding the Trex2 molecules or Trex2 polypeptides are provided herein.

In an embodiment, a nucleic acid encoding a Trex2 molecule or Trex2 polypeptide can be a synthetic nucleic acid sequence. For example, the synthetic nucleic acid molecule can be chemically modified, e.g., as described herein. In an embodiment, the Trex2 mRNA has one or more (e.g., all of the following properties: it is capped, polyadenylated, substituted with 5-methylcytidine and/or pseudouridine.

In addition, or alternatively, the synthetic nucleic acid sequence can be codon optimized, e.g., at least one non-common codon or less-common codon has been replaced by a common codon. For example, the synthetic nucleic acid can direct the synthesis of an optimized messenger mRNA, e.g., optimized for expression in a mammalian expression system, e.g., described herein.

In addition, or alternatively, a nucleic acid encoding a Trex2 molecule or Trex2 polypeptide may comprise a nuclear localization sequence (NLS). Nuclear localization sequences are known in the art.

If any of the above Trex2 sequences are fused with a peptide or polypeptide at the C-terminus, it is understood that the stop codon will be removed.

Functional Analysis of Candidate Molecules

Candidate Cas9 molecules, candidate Trex2 molecules, candidate gRNA molecules, candidate Cas9 molecule/gRNA molecule complexes, can be evaluated by art-known methods or as described herein. For example, exemplary methods for evaluating the endonuclease activity of Cas9 molecule have been described previously (Jinek et al. (2012) SCIENCE 337(6096): 816-821).

The methods in this section may be used to assess the functional capability of a candidate Cas9 molecule or a Trex2 molecule. The nuclease activity of the Cas9 molecule can be measured, e.g., the ability to mediate a nick, a single strand break, or a double strand break. The ability of the Cas9 and/or Trex2 molecule to promote resection or a particular repair process, e.g., ALT-NHEJ, canonical HDR, ALT-HDR, or SSA, can also be evaluated by using a functional assay described herein.

Binding and Cleavage Assay: Testing the Endonuclease Activity of Cas9 Molecule

The ability of a Cas9 molecule/gRNA molecule complex to bind to and cleave a target nucleic acid can be evaluated in a plasmid cleavage assay. In this assay, synthetic or in vitro-transcribed gRNA molecule is pre-annealed prior to the reaction by heating to 95° C. and slowly cooling down to room temperature. Native or restriction digest-linearized plasmid DNA (300 ng (~8 nM)) is incubated for 60 min at 37° C. with purified Cas9 protein molecule (50-500 nM) and gRNA (50-500 nM, 1:1) in a Cas9 plasmid cleavage buffer (20 mM HEPES pH 7.5, 150 mM KCl, 0.5 mM DTT, 0.1 mM EDTA) with or without 10 mM $MgCl_2$. The reactions are stopped with 5×DNA loading buffer (30% glycerol, 1.2% SDS, 250 mM EDTA), resolved by a 0.8 or 1% agarose gel electrophoresis and visualized by ethidium bromide staining. The resulting cleavage products indicate whether the Cas9 molecule cleaves both DNA strands, or only one of the two strands. For example, linear DNA products indicate the cleavage of both DNA strands. Nicked open circular products indicate that only one of the two strands is cleaved.

Alternatively, the ability of a Cas9 molecule/gRNA molecule complex to bind to and cleave a target nucleic acid can be evaluated in an oligonucleotide DNA cleavage assay. In this assay, DNA oligonucleotides (10 pmol) are radiolabeled by incubating with 5 units T4 polynucleotide kinase and ~3-6 pmol (~20-40 mCi) [γ-32P]-ATP in 1× T4 polynucleotide kinase reaction buffer at 37° C. for 30 min, in a 50 μL reaction. After heat inactivation (65° C. for 20 min), reactions are purified through a column to remove unincorporated label. Duplex substrates (100 nM) are generated by annealing labeled oligonucleotides with equimolar amounts of unlabeled complementary oligonucleotide at 95° C. for 3 min, followed by slow cooling to room temperature. For cleavage assays, gRNA molecules are annealed by heating to 95° C. for 30 s, followed by slow cooling to room temperature. Cas9 (500 nM final concentration) is pre-incubated with the annealed gRNA molecules (500 nM) in cleavage assay buffer (20 mM HEPES pH 7.5, 100 mM KCl, 5 mM MgCl2, 1 mM DTT, 5% glycerol) in a total volume of 9 μL. Reactions are initiated by the addition of 1 μL target DNA (10 nM) and incubated for 1 h at 37° C. Reactions are quenched by the addition of 20 μL of loading dye (5 mM EDTA, 0.025% SDS, 5% glycerol in formamide) and heated to 95° C. for 5 min. Cleavage products are resolved on 12% denaturing polyacrylamide gels containing 7 M urea and visualized by phosphorimaging. The resulting cleavage products indicate that whether the complementary strand, the non-complementary strand, or both, are cleaved.

One or both of these assays can be used to evaluate the suitability of a candidate gRNA molecule or candidate Cas9 molecule.

Binding Assay: Testing the Binding of Cas9 Molecule to Target DNA

Exemplary methods for evaluating the binding of Cas9 molecule to target DNA have been described previously (Jinek et al., SCIENCE 2012; 337(6096):816-821).

For example, in an electrophoretic mobility shift assay, target DNA duplexes are formed by mixing of each strand (10 nmol) in deionized water, heating to 95° C. for 3 min and slow cooling to room temperature. All DNAs are purified on 8% native gels containing 1×TBE. DNA bands are visualized by UV shadowing, excised, and eluted by soaking gel pieces in DEPC-treated $H_2O$. Eluted DNA is ethanol precipitated and dissolved in DEPC-treated $H_2O$. DNA samples are 5' end labeled with [γ-32P]-ATP using T4 polynucleotide kinase for 30 min at 37° C. Polynucleotide kinase is heat denatured at 65° C. for 20 min, and unincorporated radiolabel is removed using a column. Binding assays are performed in buffer containing 20 mM HEPES pH 7.5, 100 mM KCl, 5 mM $MgCl_2$, 1 mM DTT and 10% glycerol in a total volume of 10 μL. Cas9 protein molecule is programmed with equimolar amounts of pre-annealed gRNA molecule and titrated from 100 μM to 1 μM. Radiolabeled DNA is added to a final concentration of 20 μM. Samples are incubated for 1 h at 37° C. and resolved at 4° C. on an 8% native polyacrylamide gel containing 1×TBE and 5 mM $MgCl_2$. Gels are dried and DNA visualized by phosphorimaging.

Differential Scanning Flourimetry (DSF)

The thermostability of Cas9-gRNA ribonucleoprotein (RNP) complexes can be measured via DSF. This technique measures the thermostability of a protein, which can increase under favorable conditions such as the addition of a binding RNA molecule, e.g., a gRNA.

The assay is performed using two different protocols, one to test the best stoichiometric ratio of gRNA:Cas9 protein and another to determine the best solution conditions for RNP formation.

To determine the best solution to form RNP complexes, a 2 μM solution of Cas9 in water+10× SYPRO Orange® (Life Technologies cat #S-6650) and dispensed into a 384 well plate. An equimolar amount of gRNA diluted in solutions with varied pH and salt is then added. After incubating at room temperature for 10 minutes and brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° C. increase in temperature every 10 seconds.

The second assay consists of mixing various concentrations of gRNA with 2 uM Cas9 in optimal buffer from assay 1 above and incubating at RT for 10' in a 384 well plate. An equal volume of optimal buffer+10× SYPRO Orange® (Life Technologies cat #S-6650) is added and the plate sealed with Microseal® B adhesive (MSB-1001). Following brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° C. increase in temperature every 10 seconds.

Resection Assay: Testing the Ability of a Cas9 Molecule to Promote Resection

The ability of a Cas9 molecule to promote resection can be evaluated by measuring the levels of single stranded DNA at specific double strand break sites in human cells using quantitative methods (as described in Zhou et al., NUCLEIC ACIDS RES, 2014, 42(3):e19). In this assay, a candidate Cas9 molecule, or a candidate Cas9 molecule and a candidate Trex2 molecule, or at least one nucleic acid encoding the Cas9 molecule and/or Trex2 molecule, is delivered, e.g., by transfection, into the cell. The cells are cultured for a sufficient amount of time to allow nuclease activity and resection to occur. Genomic DNA is carefully extracted using a method in which cells are embedded in low-gelling point agar that protects the DNA from shearing and damage during extraction. The genomic DNA is digested with a restriction enzyme that selectively cuts double-stranded DNA. Primers for quantitative PCR that span up to 5 kb of the double strand break site are designed. The results from the PCR reaction show the levels of single strand DNA detected at each of the primer positions. Thus, the length and the level of resection promoted by the candidate Cas9 molecule, or the candidate Cas9 molecule in combination with the candidate Trex2 molecule, can be determined from this assay.

Other qualitative assays for identifying the occurrence of resection include the detection of proteins or protein complexes that bind to single-stranded DNA after resection has occurred, e.g., RPA foci, Rad51 foci, or BrDU detection by immunofluorescence. Antibodies for RPA protein and Rad51 are known in the art.

Repair Assays: Testing the Ability of a Cas9 Molecule to Promote DNA Repair

The ability of a Cas9 molecule to promote DNA repair by a HDR pathway, e.g., canonical HDR or ALT-HDR, can be evaluated in a cell-based GFP assay. DNA repair by a HDR pathway is typically used to correct a gene with a mutation or undesired sequence. For this assay, a cell line carrying a non-functional GFP reporter system is used. An exogenous non-functional GFP gene, e.g., a GFP with an inactivating mutation, is delivered, e.g., by transfection, into a cell. Alternatively, the cell line carries one copy of a non-functional GFP gene integrated into the genome of the cell, e.g., by transduction. A candidate Cas9 molecule, or a candidate Cas9 molecule and a candidate Trex2 molecule, or at least one nucleic acid encoding the Cas9 molecule and/or Trex2 molecule, a gRNA that mediates binding of the Cas9 molecule to the GFP gene to be corrected, and a template nucleic acid containing a functional, e.g., corrected GFP gene sequence, is delivered, e.g., by transfection, into the cell. The cells are cultured for a sufficient amount of time to allow repair and expression of the GFP gene, and GFP expression is analyzed by flow cytometry. An increase in GFP-expressing (GFP-positive) cells or an increased level of GFP signal, as compared to control (e.g., cells carrying the non-functional GFP gene that did not receive Cas9 molecule, or Cas9 and Trex2 molecules, or template nucleic acid), indicates that DNA repair occurred, resulting in gene correction. GFP positive cells can be collected by cell sorting methods, and further analyzed by various sequencing methods, e.g., MiSeq, HiSeq, or Sanger sequencing, to confirm correction of the targeted locus of the GFP gene.

Alternatively, the ability of a candidate Cas9 molecule, or a candidate Cas9 molecule and a candidate Trex2 molecule, or at least one nucleic acid encoding the Cas9 molecule and/or Trex2 molecule, to promote DNA repair by a NHEJ pathway, e.g., canonical NHEJ or ALT-NHEJ or SSA, can be evaluated in a cell-based GFP assay. DNA repair by the NHEJ pathways are typically used to disrupt a gene and prevent expression. For this assay, a cell line carrying a functional GFP reporter system is used. An exogenous functional GFP gene, e.g., a wild-type GFP gene, is delivered, e.g., by transfection, into a cell. Alternatively, the cell line carries one copy of a functional or wild-type GFP gene integrated into the genome of the cell, e.g., by transduction. A candidate Cas9 molecule, or a candidate Cas9 molecule and a candidate Trex2 molecule, or at least one nucleic acid encoding the Cas9 molecule and/or Trex2 molecule, and a gRNA that mediates binding of the Cas9 to the GFP gene is delivered, e.g., by transfection, into the cell. The cells are cultured for a sufficient amount of time to allow repair and expression of the GFP gene, and GFP expression is analyzed by flow cytometry. A decrease in GFP-expressing cells or a decrease in the level of GFP signal, as compared to control (e.g., cells carrying the functional GFP gene that did not received Cas9 molecule, or Cas9 and Trex2 molecules), indicates that DNA repair occurred, resulting in gene disruption. GFP negative cells can be collected by cell sorting methods, and further analyzed by various sequencing methods, e.g., MiSeq, HiSeq, or Sanger sequencing, to confirm disruption of the targeted locus of the GFP gene.

The distinction between SSA and ALT-NHEJ, e.g., MMEJ, is based mostly on the read-out of the sequencing assay. SSA will result in increased resection, e.g., increased length of sequence that is resected, and more than 30 bases of homology at the break point. ALT-NHEJ, e.g., MMEJ, will result in less resection, e.g., shorter length of sequence that is resected, and between 5-25 bases of microhomology.

Trex2 Exonuclease Assay

The 3' to 5' exonuclease activity of Trex2 can be tested using several assays that are well known to one of ordinary skill in the art. For example, a synthetic oligonucleotide substrate can be synthesized and radiolabeled. A reaction mixture comprising a Trex2 polypeptide can be incubated with the radiolabeled oligonucleotide substrate and exonuclease buffer. After fifteen minutes, the reaction can be quenched by the addition of ethanol, and the samples can be subjected to electrophoresis, visualized, and quantified. Specific assay conditions are described, for example, in Chen et al., NUCLEIC ACID RES., 2007, 35(8):2682-2694, the entire contents of which are expressly incorporated herein by reference.

NHEJ Approaches for Gene Targeting

In certain embodiments of the methods provided herein, NHEJ-mediated deletion is used to delete all or a portion of a gene of interest. As described herein, nuclease-induced NHEJ can be used to remove nucleotides in a gene of interest in a target-specific manner. In the methods for altering a cell or treating a subject by altering a cell described herein, the cell is contacted with a Cas9 molecule, at least one gRNA molecule, and a Trex2 molecule described herein in an amount and under conditions sufficient for NHEJ. In one embodiment, a deletion occurs in the nucleic acid of the cell, thereby altering the sequence of the nucleic acid of the cell.

While not wishing to be bound by theory, it is believed that, in certain embodiments, the genomic alterations associated with the methods described herein rely on nuclease-induced NHEJ and the error-prone nature of the NHEJ repair pathway. NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, at one or both strands, prior to rejoining of the ends. This results in the presence of insertion and/or deletion (indel) mutations in the DNA sequence at the site of the NHEJ repair. Two-thirds of these mutations typically alter the reading frame and, therefore, produce a non-functional protein. Additionally, mutations that maintain the reading frame, but which insert or delete a significant amount of sequence, can destroy functionality of the protein. This is locus dependent as mutations in critical functional domains are likely less tolerable than mutations in non-critical regions of the protein.

The indel mutations generated by NHEJ are unpredictable in nature; however, at a given break site certain indel sequences are favored and are over represented in the population, likely due to small regions of microhomology. The lengths of deletions can vary widely; they are most commonly in the 1-50 bp range, but can reach greater than 100-200 bp. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ is a mutagenic process, it can also be used to delete small sequence motifs (e.g., motifs less than or equal to 50 nucleotides in length) as long as the generation of a specific final sequence is not required. If a double-strand break is targeted near to a target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. In this way, DNA segments as large as several hundred kilobases can be deleted. Both of these approaches can be used to delete specific DNA sequences; however, the error-prone nature of NHEJ may still produce indel mutations at the site of repair.

Two distinct NHEJ pathways are described herein, canonical NHEJ and alternative NHEJ. Canonical NHEJ typically occurs when a double strand break has blunt, unresected ends that are ligation-competent. In some instances, minimal end processing, e.g., <5 nucleotide deletions or insertions, occurs, and the break ends are ligated thereby resulting in either correct (error-free) repair, or approximately 1-4 nucleotide insertions or deletions. Canonical NHEJ is dependent upon the KU70/80 and XRCC4/LigaseIV pathway for recognition of the break, minimal end processing, DNA synthesis, and ligation.

In contrast, alternative NHEJ is not depending upon the KU70/80 and XRCC4/LigaseIV pathway and typically occurs when resection of more than 5 nucleotides at the break ends occurs. In some cases, resection reveals a short span, e.g., 5 to 25 nucleotides, of homologous sequence in the overhangs, also known as microhomologies. The microhomologies anneal and the intervening sequence on the single strands between the break and the annealed microhomology region is deleted. Accordingly, ALT-NHEJ typically results in longer stretches, e.g., greater than 5 nucleotides, of deleted sequence than canonical NHEJ.

Both double strand cleaving eaCas9 molecules and single strand, or nickase, eaCas9 molecules can be used in the methods and compositions described herein to generate NHEJ-mediated indels. NHEJ-mediated indels targeted to the gene, e.g., a coding region, e.g., an early coding region of a gene of interest, can be used to knockout (i.e., eliminate expression of) a gene of interest. For example, early coding region of a gene of interest includes sequence immediately following a transcription start site, within a first exon of the coding sequence, or within 500 bp of the transcription start site (e.g., less than 500, 450, 400, 350, 300, 250, 200, 150, 100 or 50 bp).

Methods for promoting NHEJ pathways, particularly alternative NHEJ, by utilizing a Cas9 molecule and a Trex2 molecule are discussed herein.

Placement of Double Strand or Single Strand Breaks Relative to the Target Position In certain embodiments in which a gRNA and Cas9 nuclease generate a double strand break for the purpose of inducing NHEJ-mediated indels, a gRNA, e.g., a unimolecular (or chimeric) or modular gRNA molecule, is configured to position one double-strand break in close proximity to a nucleotide of the target position. In an embodiment, the cleavage site is between 0-30 bp away from the target position (e.g., less than 30, 25, 20, 15, 10, 9, 8, 7, 6, 5, 4, 3, 2, or 1 bp from the target position).

In certain embodiments in which two gRNAs complexing with Cas9 nickases induce two single strand breaks for the purpose of inducing NHEJ-mediated indels, two gRNAs, e.g., independently, unimolecular (or chimeric) or modular gRNA, are configured to position two single-strand breaks to provide for NHEJ repair a nucleotide of the target position. In certain embodiments, the gRNAs are configured to position cuts at the same position, or within a few nucleotides of one another, on different strands, essentially mimicking a double strand break. In certain embodiments, the closer nick is between 0-30 bp away from the target position (e.g., less than 30, 25, 20, 15, 10, 9, 8, 7, 6, 5, 4, 3, 2, or 1 bp from the target position), and the two nicks are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20, or 10 bp). In certain embodiments, the gRNAs are configured to place a single strand break on either side of a nucleotide of the target position.

Both double strand cleaving eaCas9 molecules and single strand, or nickase, eaCas9 molecules can be used in the methods and compositions described herein to generate breaks both sides of a target position. Double strand or paired single strand breaks may be generated on both sides of a target position to remove the nucleic acid sequence between the two cuts (e.g., the region between the two breaks in deleted). In certain embodiments, two gRNAs, e.g., independently, unimolecular (or chimeric) or modular gRNA, are configured to position a double-strand break on both sides of a target position. In other embodiments, three gRNAs, e.g., independently, unimolecular (or chimeric) or modular gRNA, are configured to position a double strand break (i.e., one gRNA complexes with a Cas9 nuclease) and two single strand breaks or paired single strand breaks (i.e., two gRNAs complex with Cas9 nickases) on either side of the target position. In still other embodiments, four gRNAs, e.g., independently, unimolecular (or chimeric) or modular gRNA, are configured to generate two pairs of single strand breaks (i.e., two pairs of two gRNAs complex with Cas9 nickases) on either side of the target position. The double strand break(s) or the closer of the two single strand nicks in a pair will ideally be within 0-500 bp of the target position (e.g., no more than 450, 400, 350, 300, 250, 200, 150, 100, 50, or 25 bp from the target position). When nickases are used, the two nicks in a pair are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20, or 10 bp).

HDR Repair, HDR-Mediated Knock-in, and Template Nucleic Acids

Nuclease-induced homology directed repair (HDR) can be used to alter a target sequence and correct (e.g., repair or edit) a mutation in the genome. While not wishing to be bound by theory, it is believed that HDR-mediated alteration of a target sequence occurs by HDR with an exogenously provided donor template or template nucleic acid. For example, the donor construct or template nucleic acid provides for alteration of the target position. It is contemplated that a plasmid donor can be used as a template for homologous recombination. In an embodiment where a double-stranded template nucleic acid is used, the target position is altered by canonical HDR. It is further contemplated that a single stranded donor template can be used as a template for alteration of the target position by alternate methods of HDR (e.g., ALT-HDR and single strand annealing) between the target position and the donor template. Donor template-effected alteration of a target position depends on cleavage by a Cas9 molecule. Cleavage by Cas9 can comprise a double strand break or two single strand breaks.

In other embodiments, HDR-mediated sequence alteration is used to alter the sequence of one or more nucleotides in a target sequence without using an exogenously provided template nucleic acid. While not wishing to be bound by theory, it is believed that alteration of the target position occurs by HDR with endogenous genomic donor sequence. For example, the endogenous genomic donor sequence provides for alteration of the target position. It is contemplated that in an embodiment the endogenous genomic donor sequence is located on the same chromosome as the target sequence. It is further contemplated that in another embodiment the endogenous genomic donor sequence is located on a different chromosome from the target sequence. Alteration of a target position by endogenous genomic donor sequence depends on cleavage by a Cas9 molecule. Cleavage by Cas9 can comprise a double strand break or two single strand breaks.

In certain embodiments of the methods provided herein, HDR-mediated alteration is used to alter a single nucleotide in a gene of interest. These embodiments may utilize either one double-strand break or two single-strand breaks. In certain embodiments, a single nucleotide alteration is incorporated using (1) one double-strand break, (2) two single-strand breaks, (3) two double-strand breaks with a break occurring on each side of the target position, (4) one double-strand break and two single strand breaks with the double strand break and two single strand breaks occurring on each side of the target position, (5) four single-strand breaks with a pair of single-strand breaks occurring on each side of the target position, or (6) one single-strand break.

In certain embodiments wherein a single-stranded template nucleic acid is used, the target position can be altered by alternative HDR.

Donor template-effected alteration of a target position depends on cleavage by a Cas9 molecule. Cleavage by Cas9 can comprise a nick, a double-strand break, or two single-strand breaks, e.g., one on each strand of the target nucleic acid. After introduction of the breaks on the target nucleic acid, resection occurs at the break ends resulting in single stranded overhanging DNA regions.

In canonical HDR, a double-stranded donor template is introduced, comprising homologous sequence to the target nucleic acid that will either be directly incorporated into the target nucleic acid or used as a template to change the sequence of the target nucleic acid. After resection at the break, repair can progress by different pathways, e.g., by the double Holliday junction model (or double-strand break repair, DSBR, pathway) or the synthesis-dependent strand annealing (SDSA) pathway. In the double Holliday junction model, strand invasion by the two single stranded overhangs of the target nucleic acid to the homologous sequences in the donor template occurs, resulting in the formation of an intermediate with two Holliday junctions. The junctions migrate as new DNA is synthesized from the ends of the invading strand to fill the gap resulting from the resection. The end of the newly synthesized DNA is ligated to the resected end, and the junctions are resolved, resulting in alteration of the target nucleic acid, e.g., incorporation of an HPFH mutant sequence of the donor template at the corresponding HBG target position. Crossover with the donor template may occur upon resolution of the junctions. In the SDSA pathway, only one single stranded overhang invades the donor template and new DNA is synthesized from the end of the invading strand to fill the gap resulting from resection. The newly synthesized DNA then anneals to the remaining single stranded overhang, new DNA is synthesized to fill in the gap, and the strands are ligated to produce the altered DNA duplex.

In alternative HDR, a single strand donor template, e.g., template nucleic acid, is introduced. A nick, single strand break, or double strand break at the target nucleic acid, for altering a desired target position, is mediated by a Cas9 molecule, e.g., described herein, and resection at the break occurs to reveal single stranded overhangs. Incorporation of the sequence of the template nucleic acid to alter the target position typically occurs by the SDSA pathway, as described above.

Additional details on template nucleic acids are provided in Section IV entitled "Template nucleic acids" in International Application PCT/US2014/057905.

Methods for promoting HDR pathways, e.g., canonical HDR or alternative HDR, by utilizing a Cas9 molecule and a Trex2 molecule are discussed herein.

In certain embodiments, double strand cleavage is effected by a Cas9 molecule having cleavage activity associated with an HNH-like domain and cleavage activity associated with a RuvC-like domain, e.g., an N-terminal RuvC-like domain, e.g., a wild-type Cas9. Such embodiments require only a single gRNA.

In certain embodiments, one single-strand break, or nick, is effected by a Cas9 molecule having nickase activity, e.g., a Cas9 nickase as described herein. A nicked target nucleic acid can be a substrate for alt-HDR.

In other embodiments, two single-strand breaks, or nicks, are effected by a Cas9 molecule having nickase activity, e.g., cleavage activity associated with an HNH-like domain or cleavage activity associated with an N-terminal RuvC-like domain. Such embodiments usually require two gRNAs, one for placement of each single-strand break. In an embodiment, the Cas9 molecule having nickase activity cleaves the strand to which the gRNA hybridizes, but not the strand that is complementary to the strand to which the gRNA hybridizes. In an embodiment, the Cas9 molecule having nickase activity does not cleave the strand to which the gRNA hybridizes, but rather cleaves the strand that is complementary to the strand to which the gRNA hybridizes.

In certain embodiments, the nickase has HNH activity, e.g., a Cas9 molecule having the RuvC activity inactivated, e.g., a Cas9 molecule having a mutation at D10, e.g., the D10A mutation (see, e.g., SEQ ID NO:10). D10A inactivates RuvC; therefore, the Cas9 nickase has (only) HNH activity and will cut on the strand to which the gRNA hybridizes (e.g., the complementary strand, which does not have the NGG PAM on it). In other embodiments, a Cas9 molecule having an H840, e.g., an H840A, mutation can be used as a nickase. H840A inactivates HNH; therefore, the Cas9 nickase has (only) RuvC activity and cuts on the non-complementary strand (e.g., the strand that has the NGG PAM and whose sequence is identical to the gRNA). In other embodiments, a Cas9 molecule having an N863 mutation, e.g., the N863A mutation, mutation can be used as a nickase. N863A inactivates HNH therefore the Cas9 nickase has (only) RuvC activity and cuts on the non-complementary strand (the strand that has the NGG PAM and whose sequence is identical to the gRNA).

In certain embodiments, in which a nickase and two gRNAs are used to position two single strand nicks, one nick is on the + strand and one nick is on the − strand of the target nucleic acid. The PAMs can be outwardly facing. The gRNAs can be selected such that the gRNAs are separated by, from about 0-50, 0-100, or 0-200 nucleotides. In an embodiment, there is no overlap between the target sequences that are complementary to the targeting domains of the two gRNAs. In an embodiment, the gRNAs do not overlap and are separated by as much as 50, 100, or 200 nucleotides. In an embodiment, the use of two gRNAs can increase specificity, e.g., by decreasing off-target binding (Ran 2013).

In certain embodiments, a single nick can be used to induce HDR, e.g., alt-HDR. It is contemplated herein that a single nick can be used to increase the ratio of HR to NHEJ at a given cleavage site. In an embodiment, a single strand break is formed in the strand of the target nucleic acid to which the targeting domain of said gRNA is complementary. In other embodiments, a single strand break is formed in the strand of the target nucleic acid other than the strand to which the targeting domain of said gRNA is complementary.

Placement of Double Strand or Single Strand Breaks Relative to the Target Position A double strand break or single strand break in one of the strands should be sufficiently close to a target position such that an alteration is produced in the desired region, e.g., correction of a mutation occurs. In certain embodiments, the distance is not more than 50, 100, 200, 300, 350 or 400 nucleotides. While not wishing to be bound by theory, in certain embodiments it is believed that the break should be sufficiently close to target position such that the target position is within the region that is subject to exonuclease-mediated removal during end resection. If the distance between the target position and a break is too great, the mutation or other sequence desired to be altered may not be included in the end resection and, therefore, may not be altered, as donor sequence, either exogenously provided donor sequence or endogenous genomic donor sequence, in some embodiments is only used to alter sequence within the end resection region.

In certain embodiments, the gRNA targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150, or 200 nucleotides of the region desired to be altered, e.g., a mutation. The break, e.g., a double strand or single strand break, can be positioned upstream or downstream of the region desired to be altered, e.g., a mutation. In some embodiments, a break is positioned within the region desired to be altered, e.g., within a region defined by at least two mutant nucleotides. In some embodiments, a break is positioned immediately adjacent to the region desired to be altered, e.g., immediately upstream or downstream of a mutation.

In certain embodiments, a single strand break is accompanied by an additional single strand break, positioned by a second gRNA molecule, as discussed below. For example, the targeting domains bind configured such that a cleavage event, e.g., the two single strand breaks, are positioned within 1, 2, 3, 4, 5, 10, 15, 20, 25, 30, 35, 40, 45, 50, 60, 70, 80, 90, 100, 150, or 200 nucleotides of a target position. In an embodiment, the first and second gRNA molecules are configured such that, when guiding a Cas9 nickase, a single strand break will be accompanied by an additional single strand break, positioned by a second gRNA, sufficiently close to one another to result in alteration of the desired region. In an embodiment, the first and second gRNA molecules are configured such that a single strand break positioned by said second gRNA is within 10, 20, 30, 40, or 50 nucleotides of the break positioned by said first gRNA molecule, e.g., when the Cas9 is a nickase. In an embodiment, the two gRNA molecules are configured to position cuts at the same position, or within a few nucleotides of one another, on different strands, e.g., essentially mimicking a double strand break.

In certain embodiments in which a gRNA (unimolecular (or chimeric) or modular gRNA) and Cas9 nuclease induce a double strand break for the purpose of inducing HDR-mediated sequence alteration, the cleavage site is between 0-200 bp (e.g., 0 to 175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position. In certain embodiments, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position.

In certain embodiments, one can promote HDR by using nickases to generate a break with overhangs. While not wishing to be bound by theory, the single stranded nature of the overhangs can enhance the cell's likelihood of repairing the break by HDR as opposed to, e.g., NHEJ. Specifically, in some embodiments, HDR is promoted by selecting a first gRNA that targets a first nickase to a first target sequence, and a second gRNA that targets a second nickase to a second target sequence which is on the opposite DNA strand from the first target sequence and offset from the first nick.

In certain embodiments, the targeting domain of a gRNA molecule is configured to position a cleavage event sufficiently far from a preselected nucleotide that the nucleotide is not altered. In certain embodiments, the targeting domain of a gRNA molecule is configured to position an intronic cleavage event sufficiently far from an intron/exon border, or naturally occurring splice signal, to avoid alteration of the exonic sequence or unwanted splicing events. The gRNA molecule may be a first, second, third and/or fourth gRNA molecule, as described herein.

Placement of a First Break and a Second Break Relative to Each Other

In certain embodiments, a double strand break can be accompanied by an additional double strand break, positioned by a second gRNA molecule, as is discussed below.

In certain embodiments, a double strand break can be accompanied by two additional single strand breaks, positioned by a second gRNA molecule and a third gRNA molecule.

In certain embodiments, a first and second single strand breaks can be accompanied by two additional single strand breaks positioned by a third gRNA molecule and a fourth gRNA molecule.

When two or more gRNAs are used to position two or more cleavage events, e.g., double strand or single strand breaks, in a target nucleic acid, it is contemplated that the two or more cleavage events may be made by the same or different Cas9 proteins. For example, when two gRNAs are used to position two double stranded breaks, a single Cas9 nuclease may be used to create both double stranded breaks. When two or more gRNAs are used to position two or more single stranded breaks (nicks), a single Cas9 nickase may be used to create the two or more nicks. When two or more gRNAs are used to position at least one double stranded break and at least one single stranded break, two Cas9 proteins may be used, e.g., one Cas9 nuclease and one Cas9 nickase. It is contemplated that when two or more Cas9 proteins are used that the two or more Cas9 proteins may be delivered sequentially to control specificity of a double stranded versus a single stranded break at the desired position in the target nucleic acid.

In some embodiments, the targeting domain of the first gRNA molecule and the targeting domain of the second gRNA molecules are complementary to opposite strands of the target nucleic acid molecule. In some embodiments, the gRNA molecule and the second gRNA molecule are configured such that the PAMs are oriented outward.

In certain embodiments, two gRNA are selected to direct Cas9-mediated cleavage at two positions that are a preselected distance from each other. In certain embodiments, the two points of cleavage are on opposite strands of the target nucleic acid. In some embodiments, the two cleavage points form a blunt ended break, and in other embodiments, they are offset so that the DNA ends comprise one or two overhangs (e.g., one or more 5' overhangs and/or one or more 3' overhangs). In some embodiments, each cleavage event is a nick. In certain embodiments, the nicks are close enough together that they form a break that is recognized by the double stranded break machinery (as opposed to being recognized by, e.g., the SSBr machinery). In certain embodiments, the nicks are far enough apart that they create an overhang that is a substrate for HDR, i.e., the placement of the breaks mimics a DNA substrate that has experienced some resection. For instance, in some embodiments the nicks are spaced to create an overhang that is a substrate for processive resection. In some embodiments, the two breaks are spaced within 25-65 nucleotides of each other. The two breaks may be, e.g., about 25, 30, 35, 40, 45, 50, 55, 60, or 65 nucleotides of each other. The two breaks may be, e.g., at least about 25, 30, 35, 40, 45, 50, 55, 60, or 65 nucleotides of each other. The two breaks may be, e.g., at most about 30, 35, 40, 45, 50, 55, 60, or 65 nucleotides of each other. In certain embodiments, the two breaks are about 25-30, 30-35, 35-40, 40-45, 45-50, 50-55, 55-60, or 60-65 nucleotides of each other.

In some embodiments, the break that mimics a resected break comprises a 3' overhang (e.g., generated by a DSB and a nick, where the nick leaves a 3' overhang), a 5' overhang (e.g., generated by a DSB and a nick, where the nick leaves a 5' overhang), a 3' and a 5' overhang (e.g., generated by three cuts), two 3' overhangs (e.g., generated by two nicks that are offset from each other), or two 5' overhangs (e.g., generated by two nicks that are offset from each other).

In certain embodiments in which two gRNAs (independently, unimolecular (or chimeric) or modular gRNA) complexing with Cas9 nickases induce two single strand breaks for the purpose of inducing HDR-mediated alteration, the closer nick is between 0-200 bp (e.g., 0 to 175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, or 75 to 100 bp) away from the target position and the two nicks will ideally be within 25-65 bp of each other (e.g., 25 to 50, 25 to 45, 25 to 40, 25 to 35, 25 to 30, 30 to 55, 30 to 50, 30 to 45, 30 to 40, 30 to 35, 35 to 55, 35 to 50, 35 to 45, 35 to 40, 40 to 55, 40 to 50, 40 to 45 bp, 45 to 50 bp, 50 to 55 bp, 55 to 60 bp, or 60 to 65 bp) and no more than 100 bp away from each other (e.g., no more than 90, 80, 70, 60, 50, 40, 30, 20, 10, or 5 bp away from each other). In certain embodiments, the cleavage site is between 0-100 bp (e.g., 0 to 75, 0 to 50, 0 to 25, 25 to 100, 25 to 75, 25 to 50, 50 to 100, 50 to 75, or 75 to 100 bp) away from the target position.

In some embodiments, two gRNAs, e.g., independently, unimolecular (or chimeric) or modular gRNA, are configured to position a double-strand break on both sides of a target position. In other embodiments, three gRNAs, e.g., independently, unimolecular (or chimeric) or modular gRNA, are configured to position a double strand break (i.e., one gRNA complexes with a Cas9 nuclease) and two single strand breaks or paired single stranded breaks (i.e., two gRNAs complex with Cas9 nickases) on either side of the target position. In other embodiments, four gRNAs, e.g., independently, unimolecular (or chimeric) or modular gRNA, are configured to generate two pairs of single stranded breaks (i.e., two pairs of two gRNAs complex with Cas9 nickases) on either side of the target position. The double strand break(s) or the closer of the two single strand nicks in a pair will ideally be within 0-500 bp of the target position (e.g., no more than 450, 400, 350, 300, 250, 200, 150, 100, 50 or 25 bp from the target position). When nickases are used, the two nicks in a pair are, in certain embodiments, within 25-65 bp of each other (e.g., between 25 to 55, 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, 40 to 45 bp, 45 to 50 bp, 50 to 55 bp, 55 to 60 bp, or 60 to 65 bp) and no more than 100 bp away from each other (e.g., no more than 90, 80, 70, 60, 50, 40, 30, or 20 or 10 bp).

When two gRNAs are used to target Cas9 molecules to breaks, different combinations of Cas9 molecules are envisioned. In some embodiments, a first gRNA is used to target a first Cas9 molecule to a first target position, and a second gRNA is used to target a second Cas9 molecule to a second target position. In some embodiments, the first Cas9 molecule creates a nick on the first strand of the target nucleic acid, and the second Cas9 molecule creates a nick on the opposite strand, resulting in a double stranded break (e.g., a blunt ended cut or a cut with overhangs).

Different combinations of nickases can be chosen to target one single stranded break to one strand and a second single stranded break to the opposite strand. When choosing a combination, one can take into account that there are nickases having one active RuvC-like domain, and nickases having one active HNH domain. In certain embodiments, a RuvC-like domain cleaves the non-complementary strand of the target nucleic acid molecule. In certain embodiments, an HNH-like domain cleaves a single stranded complementary domain, e.g., a complementary strand of a double stranded nucleic acid molecule. Generally, if both Cas9 molecules have the same active domain (e.g., both have an active RuvC domain or both have an active HNH domain), one will choose two gRNAs that bind to opposite strands of the target. In more detail, in some embodiments a first gRNA is complementary with a first strand of the target nucleic acid and binds a nickase having an active RuvC-like domain and causes that nickase to cleave the strand that is non-complementary to that first gRNA, i.e., a second strand of the target nucleic acid; and a second gRNA is complementary with a second strand of the target nucleic acid and binds a nickase having an active RuvC-like domain and causes that nickase to cleave the strand that is non-complementary to that second gRNA, i.e., the first strand of the target nucleic acid. Conversely, in some embodiments, a first gRNA is complementary with a first strand of the target nucleic acid and binds a nickase having an active HNH domain and causes that nickase to cleave the strand that is complementary to that first gRNA, i.e., a first strand of the target nucleic acid; and a second gRNA is complementary with a second strand of the target nucleic acid and binds a nickase having an active HNH domain and causes that nickase to cleave the strand that is complementary to that second gRNA, i.e., the second strand of the target nucleic acid. In another arrangement, if one Cas9 molecule has an active RuvC-like domain and the other Cas9 molecule has an active HNH domain, the gRNAs for both Cas9 molecules can be complementary to the same strand of the target nucleic acid, so that the Cas9 molecule with the active RuvC-like domain will cleave the non-complementary strand and the Cas9 molecule with the HNH domain will cleave the complementary strand, resulting in a double stranded break.

Homology Arms of the Donor Template

A homology arm should extend at least as far as the region in which end resection may occur, e.g., in order to allow the resected single stranded overhang to find a complementary region within the donor template. The overall length could be limited by parameters such as plasmid size or viral packaging limits. In an embodiment, a homology arm does not extend into repeated elements, e.g., Alu repeats or LINE repeats.

Exemplary homology arm lengths include at least 50, 100, 250, 500, 750, 1000, 2000, 3000, 4000, or 5000 nucleotides. In some embodiments, the homology arm length is 50-100, 100-250, 250-500, 500-750, 750-1000, 1000-2000, 2000-3000, 3000-4000, or 4000-5000 nucleotides.

A template nucleic acid, as that term is used herein, refers to a nucleic acid sequence which can be used in conjunction with a Cas9 molecule and a gRNA molecule to alter the structure of a target position. In certain embodiments, the target position can be a site between two nucleotides, e.g., adjacent nucleotides, on the target nucleic acid into which one or more nucleotides is added. Alternatively, the target position may comprise one or more nucleotides that are altered by a template nucleic acid.

In certain embodiments, the target nucleic acid is modified to have some or all of the sequence of the template nucleic acid, typically at or near cleavage site(s). In certain embodiments, the template nucleic acid is single stranded. In other embodiments, the template nucleic acid is double stranded. In certain embodiments, the template nucleic acid is DNA, e.g., double stranded DNA. In other embodiments, the template nucleic acid is single stranded DNA. In an embodiment, the template nucleic acid is encoded on the same vector backbone, e.g. AAV genome, plasmid DNA, as the Cas9 and gRNA. In certain embodiments, the template nucleic acid is excised from a vector backbone in vivo, e.g., it is flanked by gRNA recognition sequences. In certain embodiments, the template nucleic acid comprises endogenous genomic sequence.

In certain embodiments, the template nucleic acid alters the structure of the target position by participating in an HDR event. In certain embodiments, the template nucleic acid alters the sequence of the target position. In certain embodiments, the template nucleic acid results in the incorporation of a modified, or non-naturally occurring base into the target nucleic acid.

Typically, the template sequence undergoes a breakage mediated or catalyzed recombination with the target sequence. In certain embodiments, the template nucleic acid includes sequence that corresponds to a site on the target sequence that is cleaved by an eaCas9 mediated cleavage event. In certain embodiments, the template nucleic acid includes sequence that corresponds to both a first site on the target sequence that is cleaved in a first Cas9 mediated event, and a second site on the target sequence that is cleaved in a second Cas9 mediated event.

A template nucleic acid having homology with a target position in a gene of interest can be used to alter the structure of the gene of interest.

A template nucleic acid typically comprises the following components:

[5' homology arm]-[replacement sequence]-[3' homology arm].

The homology arms provide for recombination into the chromosome, thus replacing the undesired element, e.g., a mutation or signature, with a replacement sequence, e.g., the desired, or corrected sequence. In certain embodiments, the homology arms flank the most distal cleavage sites.

In certain embodiments, the 3' end of the 5' homology arm is the position next to the 5' end of the replacement sequence. In certain embodiments, the 5' homology arm can extend at least 10, 20, 30, 40, 50, 100, 200, 300, 400, 500, 600, 700, 800, 900, 1000, 1500, 2000, 3000, 4000, or 5000 nucleotides 5' from the 5' end of the replacement sequence.

In certain embodiments, the 5' end of the 3' homology arm is the position next to the 3' end of the replacement sequence. In an embodiment, the 3' homology arm can extend at least 10, 20, 30, 40, 50, 100, 200, 300, 400, 500, 600, 700, 800, 900, 1000, 1500, 2000, 3000, 4000, or 5000 nucleotides 3' from the 3' end of the replacement sequence.

In certain embodiments, to alter one or more nucleotides at a target position, the homology arms, e.g., the 5' and 3' homology arms, may each comprise about 1000 bp of sequence flanking the most distal gRNAs (e.g., 1000 bp of sequence on either side of the target position).

It is contemplated herein that one or both homology arms may be shortened to avoid including certain sequence repeat elements, e.g., Alu repeats or LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

It is contemplated herein that template nucleic acids for altering the sequence of a target position may be designed for use as a single-stranded oligonucleotide, e.g., a single-stranded oligodeoxynucleotide (ssODN). When using a ssODN, 5' and 3' homology arms may range up to about 200 bp in length, e.g., at least 25, 50, 75, 100, 125, 150, 175, or 200 bp in length. Longer homology arms are also contemplated for ssODNs as improvements in oligonucleotide synthesis continue to be made. In some embodiments, a longer homology arm is made by a method other than chemical synthesis, e.g., by denaturing a long double stranded nucleic acid and purifying one of the strands, e.g., by affinity for a strand-specific sequence anchored to a solid substrate.

While not wishing to be bound by theory, in certain embodiments alt-HDR proceeds more efficiently when the template nucleic acid has extended homology 5' to the nick (i.e., in the 5' direction of the nicked strand). Accordingly, in some embodiments, the template nucleic acid has a longer homology arm and a shorter homology arm, wherein the longer homology arm can anneal 5' of the nick. In some embodiments, the arm that can anneal 5' to the nick is at least 25, 50, 75, 100, 125, 150, 175, or 200, 300, 400, 500, 600, 700, 800, 900, 1000, 1500, 2000, 3000, 4000, or 5000 nucleotides from the nick or the 5' or 3' end of the replacement sequence. In some embodiments, the arm that can anneal 5' to the nick is at least 10%, 20%, 30%, 40%, or 50% longer than the arm that can anneal 3' to the nick. In some embodiments, the arm that can anneal 5' to the nick is at least 2×, 3×, 4×, or 5× longer than the arm that can anneal 3' to the nick. Depending on whether a ssDNA template can anneal to the intact strand or the nicked strand, the homology arm that anneals 5' to the nick may be at the 5' end of the ssDNA template or the 3' end of the ssDNA template, respectively.

Similarly, in some embodiments, the template nucleic acid has a 5' homology arm, a replacement sequence, and a 3' homology arm, such that the template nucleic acid has extended homology to the 5' of the nick. For example, the 5' homology arm and 3' homology arm may be substantially the same length, but the replacement sequence may extend farther 5' of the nick than 3' of the nick. In some embodiments, the replacement sequence extends at least 10%, 20%, 30%, 40%, 50%, 2×, 3×, 4×, or 5× further to the 5' end of the nick than the 3' end of the nick.

While not wishing to be bound by theory, in some embodiments alt-HDR proceeds more efficiently when the template nucleic acid is centered on the nick. Accordingly, in some embodiments, the template nucleic acid has two homology arms that are essentially the same size. For instance, the first homology arm of a template nucleic acid may have a length that is within 10%, 9%, 8%, 7%, 6%, 5%, 4%, 3%, 2%, or 1% of the second homology arm of the template nucleic acid.

Similarly, in some embodiments, the template nucleic acid has a 5' homology arm, a replacement sequence, and a 3' homology arm, such that the template nucleic acid extends substantially the same distance on either side of the nick. For example, the homology arms may have different lengths, but the replacement sequence may be selected to compensate for this. For example, the replacement sequence may extend further 5' from the nick than it does 3' of the nick, but the homology arm 5' of the nick is shorter than the homology arm 3' of the nick, to compensate. The converse is also possible, e.g., that the replacement sequence may extend further 3' from the nick than it does 5' of the nick, but the homology arm 3' of the nick is shorter than the homology arm 5' of the nick, to compensate.

Exemplary Template Nucleic Acids

In certain embodiments, the template nucleic acid is double stranded. In other embodiments, the template nucleic acid is single stranded. In certain embodiments, the template nucleic acid comprises a single stranded portion and a double stranded portion. In certain embodiments, the template nucleic acid comprises about 50 to 100 bp, e.g., 55 to 95, 60 to 90, 65 to 85, or 70 to 80 bp, homology on either side of the nick and/or replacement sequence. In certain embodiments, the template nucleic acid comprises about 50, 55, 60, 65, 70, 75, 80, 85, 90, 95, or 100 bp homology 5' of the nick or replacement sequence, 3' of the nick or replacement sequence, or both 5' and 3' of the nick or replacement sequences.

In certain embodiments, the template nucleic acid comprises about 150 to 200 bp, e.g., 155 to 195, 160 to 190, 165 to 185, or 170 to 180 bp, homology 3' of the nick and/or replacement sequence. In certain embodiments, the template nucleic acid comprises about 150, 155, 160, 165, 170, 175, 180, 185, 190, 195, or 200 bp homology 3' of the nick or replacement sequence. In certain embodiments, the template nucleic acid comprises less than about 100, 90, 80, 70, 60, 50, 40, 30, 20, 15, or 10 bp homology 5' of the nick or replacement sequence.

In certain embodiment, the template nucleic acid comprises about 150 to 200 bp, e.g., 155 to 195, 160 to 190, 165 to 185, or 170 to 180 bp, homology 5' of the nick and/or replacement sequence. In certain embodiment, the template nucleic acid comprises about 150, 155, 160, 165, 170, 175, 180, 185, 190, 195, or 200 bp homology 5' of the nick or replacement sequence. In certain embodiments, the template nucleic acid comprises less than about 100, 90, 80, 70, 60, 50, 40, 30, 20, 15, or 10 bp homology 3' of the nick or replacement sequence.

In certain embodiments, the template nucleic acid comprises a nucleotide sequence, e.g., of one or more nucleotides, that will be added to or will template a change in the target nucleic acid. In other embodiments, the template nucleic acid comprises a nucleotide sequence that may be used to modify the target position.

The template nucleic acid may comprise a replacement sequence. In some embodiments, the template nucleic acid comprises a 5' homology arm. In other embodiments, the template nucleic acid comprises a 3' homology arm.

In certain embodiments, the template nucleic acid is linear double stranded DNA. The length may be, e.g., about 150-200 bp, e.g., about 150, 160, 170, 180, 190, or 200 bp. The length may be, e.g., at least 150, 160, 170, 180, 190, or 200 bp. In some embodiments, the length is no greater than 150, 160, 170, 180, 190, or 200 bp. In some embodiments, a double stranded template nucleic acid has a length of about 160 bp, e.g., about 155-165, 150-170, 140-180, 130-190, 120-200, 110-210, 100-220, 90-230, or 80-240 bp.

The template nucleic acid can be linear single stranded DNA. In certain embodiments, the template nucleic acid is (i) linear single stranded DNA that can anneal to the nicked strand of the target nucleic acid, (ii) linear single stranded DNA that can anneal to the intact strand of the target nucleic acid, (iii) linear single stranded DNA that can anneal to the plus strand of the target nucleic acid, (iv) linear single stranded DNA that can anneal to the minus strand of the target nucleic acid, or more than one of the preceding. The length may be, e.g., about 150-200 nucleotides, e.g., about 150, 160, 170, 180, 190, or 200 nucleotides. The length may be, e.g., at least 150, 160, 170, 180, 190, or 200 nucleotides. In some embodiments, the length is no greater than 150, 160, 170, 180, 190, or 200 nucleotides. In some embodiments, a single stranded template nucleic acid has a length of about 160 nucleotides, e.g., about 155-165, 150-170, 140-180, 130-190, 120-200, 110-210, 100-220, 90-230, or 80-240 nucleotides.

In some embodiments, the template nucleic acid is circular double stranded DNA, e.g., a plasmid. In some embodiments, the template nucleic acid comprises about 500 to 1000 bp of homology on either side of the replacement sequence and/or the nick. In some embodiments, the template nucleic acid comprises about 300, 400, 500, 600, 700, 800, 900, 1000, 1500, or 2000 bp of homology 5' of the nick or replacement sequence, 3' of the nick or replacement sequence, or both 5' and 3' of the nick or replacement sequence. In some embodiments, the template nucleic acid comprises at least 300, 400, 500, 600, 700, 800, 900, 1000, 1500, or 2000 bp of homology 5' of the nick or replacement sequence, 3' of the nick or replacement sequence, or both 5' and 3' of the nick or replacement sequence. In some embodiments, the template nucleic acid comprises no more than 300, 400, 500, 600, 700, 800, 900, 1000, 1500, or 2000 bp of homology 5' of the nick or replacement sequence, 3' of the nick or replacement sequence, or both 5' and 3' of the nick or replacement sequence.

In certain embodiments, one or both homology arms may be shortened to avoid including certain sequence repeat elements, e.g., Alu repeats, LINE elements. For example, a 5' homology arm may be shortened to avoid a sequence repeat element, while a 3' homology arm may be shortened to avoid a sequence repeat element. In some embodiments, both the 5' and the 3' homology arms may be shortened to avoid including certain sequence repeat elements.

In some embodiments, the template nucleic acid is an adenovirus vector, e.g., an AAV vector, e.g., a ssDNA molecule of a length and sequence that allows it to be packaged in an AAV capsid. The vector may be, e.g., less than 5 kb and may contain an ITR sequence that promotes packaging into the capsid. The vector may be integration-deficient. In some embodiments, the template nucleic acid comprises about 150 to 1000 nucleotides of homology on either side of the replacement sequence and/or the nick. In some embodiments, the template nucleic acid comprises about 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence. In some embodiments, the template nucleic acid comprises at least 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence. In some embodiments, the template nucleic acid comprises at most 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence.

In some embodiments, the template nucleic acid is a lentiviral vector, e.g., an IDLV (integration deficiency lentivirus). In some embodiments, the template nucleic acid comprises about 500 to 1000 bp of homology on either side of the replacement sequence and/or the nick. In some embodiments, the template nucleic acid comprises about 300, 400, 500, 600, 700, 800, 900, 1000, 1500, or 2000 bp of homology 5' of the nick or replacement sequence, 3' of the nick or replacement sequence, or both 5' and 3' of the nick or replacement sequence. In some embodiments, the template nucleic acid comprises at least 300, 400, 500, 600, 700, 800, 900, 1000, 1500, or 2000 bp of homology 5' of the nick or replacement sequence, 3' of the nick or replacement sequence, or both 5' and 3' of the nick or replacement sequence. In some embodiments, the template nucleic acid comprises no more than 300, 400, 500, 600, 700, 800, 900, 1000, 1500, or 2000 bp of homology 5' of the nick or replacement sequence, 3' of the nick or replacement sequence, or both 5' and 3' of the nick or replacement sequence.

In an embodiment, the template nucleic acid comprises one or more mutations, e.g., silent mutations, that prevent Cas9 from recognizing and cleaving the template nucleic acid. The template nucleic acid may comprise, e.g., at least 1, 2, 3, 4, 5, 10, 20, or 30 silent mutations relative to the corresponding sequence in the genome of the cell to be altered. In certain embodiments, the template nucleic acid comprises at most 2, 3, 4, 5, 10, 20, 30, or 50 silent mutations relative to the corresponding sequence in the genome of the cell to be altered. In an embodiment, the cDNA comprises one or more mutations, e.g., silent mutations that prevent Cas9 from recognizing and cleaving the template nucleic acid. The template nucleic acid may comprise, e.g., at least 1, 2, 3, 4, 5, 10, 20, or 30 silent mutations relative to the corresponding sequence in the genome of the cell to be altered. In certain embodiments, the template nucleic acid comprises at most 2, 3, 4, 5, 10, 20, 30, or 50 silent mutations relative to the corresponding sequence in the genome of the cell to be altered.

In certain embodiments, a template nucleic acid for altering a single nucleotide in a gene of interest comprises, from the 5' to 3' direction, a 5' homology arm, a replacement sequence, and a 3' homology arm, wherein the replacement is designed to incorporate the single nucleotide alteration.

In certain embodiments, the 5' and 3' homology arms each comprise a length of sequence flanking the nucleotides corresponding to the replacement sequence. In certain embodiments, a template nucleic acid comprises a replacement sequence flanked by a 5' homology arm and a 3' homology arm each independently comprising 10 or more, 20 or more, 50 or more, 100 or more, 150 or more, 200 or more, 250 or more, 300 or more, 350 or more, 400 or more, 450 or more, 500 or more, 550 or more, 600 or more, 650 or more, 700 or more, 750 or more, 800 or more, 850 or more, 900 or more, 1000 or more, 1100 or more, 1200 or more, 1300 or more, 1400 or more, 1500 or more, 1600 or more, 1700 or more, 1800 or more, 1900 or more, or 2000 or more nucleotides. In certain embodiments, a template nucleic acid comprises a replacement sequence flanked by a 5' homology arm and a 3' homology arm each independently comprising at least 50, 100, or 150 nucleotides, but not long enough to include a repeated element. In certain embodiments, a template nucleic acid comprises a replacement sequence flanked by a 5' homology arm and a 3' homology arm each independently comprising 5 to 100, 10 to 150, or 20 to 150 nucleotides. In certain embodiments, the replacement sequence optionally comprises a promoter and/or polyA signal.

Single-Strand Annealing

Single strand annealing (SSA) is another DNA repair process that repairs a double-strand break between two repeat sequences present in a target nucleic acid. Repeat sequences utilized by the SSA pathway are generally greater than 30 nucleotides in length. Resection at the break ends occurs to reveal repeat sequences on both strands of the target nucleic acid. After resection, single strand overhangs containing the repeat sequences are coated with RPA protein to prevent the repeats sequences from inappropriate annealing, e.g., to themselves. RAD52 binds to and each of the repeat sequences on the overhangs and aligns the sequences to enable the annealing of the complementary repeat sequences. After annealing, the single-strand flaps of the overhangs are cleaved. New DNA synthesis fills in any gaps, and ligation restores the DNA duplex. As a result of the processing, the DNA sequence between the two repeats is deleted. The length of the deletion can depend on many factors including the location of the two repeats utilized, and the pathway or processivity of the resection.

In contrast to HDR pathways, SSA does not require a template nucleic acid to alter a target nucleic acid sequence. Instead, the complementary repeat sequence is utilized.

Other DNA Repair Pathways

SSBR (Single Strand Break Repair)

Single-stranded breaks (SSB) in the genome are repaired by the SSBR pathway, which is a distinct mechanism from the DSB repair mechanisms discussed above. The SSBR pathway has four major stages: SSB detection, DNA end processing, DNA gap filling, and DNA ligation. A more detailed explanation is given in Caldecott, NATURE REVIEWS GENETICS 9, 619-631 (August 2008), and a summary is given here.

In the first stage, when a SSB forms, PARP1 and/or PARP2 recognize the break and recruit repair machinery. The binding and activity of PARP1 at DNA breaks is transient and it seems to accelerate SSBr by promoting the focal accumulation or stability of SSBr protein complexes at the lesion. Arguably the most important of these SSBr proteins is XRCC1, which functions as a molecular scaffold that interacts with, stabilizes, and stimulates multiple enzymatic components of the SSBr process including the protein responsible for cleaning the DNA 3' and 5' ends. For instance, XRCC1 interacts with several proteins (DNA polymerase beta, PNK, and three nucleases, APE1, APTX, and APLF) that promote end processing. APE1 has endonuclease activity. APLF exhibits endonuclease and 3' to 5' exonuclease activities. APTX has endonuclease and 3' to 5' exonuclease activity.

This end processing is an important stage of SSBR since the 3'- and/or 5'-termini of most, if not all, SSBs are 'damaged'. End processing generally involves restoring a damaged 3'-end to a hydroxylated state and and/or a damaged 5' end to a phosphate moiety, so that the ends become ligation-competent. Enzymes that can process damaged 3' termini include PNKP, APE1, and TDP1. Enzymes that can process damaged 5' termini include PNKP, DNA polymerase beta, and APTX. LIG3 (DNA ligase III) can also participate in end processing. Once the ends are cleaned, gap filling can occur.

At the DNA gap filling stage, the proteins typically present are PARP1, DNA polymerase beta, XRCC1, FEN1 (flap endonuclease 1), DNA polymerase delta/epsilon, PCNA, and LIG1. There are two ways of gap filling, the short patch repair and the long patch repair. Short patch repair involves the insertion of a single nucleotide that is missing. At some SSBs, "gap filling" might continue displacing two or more nucleotides (displacement of up to 12 bases have been reported). FEN1 is an endonuclease that removes the displaced 5'-residues. Multiple DNA polymerases, including Polβ, are involved in the repair of SSBs, with the choice of DNA polymerase influenced by the source and type of SSB.

In the fourth stage, a DNA ligase such as LIG1 (Ligase I) or LIG3 (Ligase III) catalyzes joining of the ends. Short patch repair uses Ligase III and long patch repair uses Ligase I.

Sometimes, SSBR is replication-coupled. This pathway can involve one or more of CtIP, MRN, ERCC1, and FEN1. Additional factors that may promote SSBR include: aPARP, PARP1, PARP2, PARG, XRCC1, DNA polymerase b, DNA polymerase d, DNA polymerase e, PCNA, LIG1, PNK, PNKP, APE1, APTX, APLF, TDP1, LIG3, FEN1, CtIP, MRN, and ERCC1.

MMR (Mismatch Repair)

Cells contain three excision repair pathways: MMR, BER, and NER. The excision repair pathways have a common feature in that they typically recognize a lesion on one strand of the DNA, then exo/endonucleases remove the lesion and leave a 1-30 nucleotide gap that is sub-sequentially filled in by DNA polymerase and finally sealed with ligase. A more complete picture is given in Li, CELL RESEARCH (2008) 18:85-98, and a summary is provided here.

Mismatch repair (MMR) operates on mispaired DNA Bases.

The MSH2/6 or MSH2/3 complexes both have ATPases activity that plays an important role in mismatch recognition and the initiation of repair. MSH2/6 preferentially recognizes base-base mismatches and identifies mispairs of 1 or 2 nucleotides, while MSH2/3 preferentially recognizes larger ID mispairs.

hMLH1 heterodimerizes with hPMS2 to form hMutLα which possesses an ATPase activity and is important for multiple steps of MMR. It possesses a PCNA/replication factor C (RFC)-dependent endonuclease activity which plays an important role in 3' nick-directed MMR involving EXO1 (EXO1 is a participant in both HR and MMR.) It regulates termination of mismatch-provoked excision. Ligase I is the relevant ligase for this pathway. Additional factors that may promote MMR include: EXO1, MSH2, MSH3, MSH6, MLH1, PMS2, MLH3, DNA Pol d, RPA, HMGB 1, RFC, and DNA ligase I.

Base Excision Repair (BER)

The base excision repair (BER) pathway is active throughout the cell cycle; it is responsible primarily for removing small, non-helix-distorting base lesions from the genome. In contrast, the related Nucleotide Excision Repair pathway (discussed in the next section) repairs bulky helix-distorting lesions. A more detailed explanation is given in Caldecott, NATURE REVIEWS GENETICS 9, 619-631 (August 2008), and a summary is given here.

Upon DNA base damage, base excision repair (BER) is initiated and the process can be simplified into five major steps: (a) removal of the damaged DNA base; (b) incision of the subsequent a basic site; (c) clean-up of the DNA ends; (d) insertion of the desired nucleotide into the repair gap;

and (e) ligation of the remaining nick in the DNA backbone. These last steps are similar to the SSBR.

In the first step, a damage-specific DNA glycosylase excises the damaged base through cleavage of the N-glycosidic bond linking the base to the sugar phosphate backbone. Then AP endonuclease-1 (APE1) or bifunctional DNA glycosylases with an associated lyase activity incised the phosphodiester backbone to create a DNA single strand break (SSB). The third step of BER involves cleaning-up of the DNA ends. The fourth step in BER is conducted by Polβ that adds a new complementary nucleotide into the repair gap and in the final step XRCC1/Ligase III seals the remaining nick in the DNA backbone. This completes the short-patch BER pathway in which the majority (~80%) of damaged DNA bases are repaired. However, if the 5' ends in step 3 are resistant to end processing activity, following one nucleotide insertion by Pol β there is then a polymerase switch to the replicative DNA polymerases, Pol δ/ε, which then add ~2-8 more nucleotides into the DNA repair gap. This creates a 5' flap structure, which is recognized and excised by flap endonuclease-1 (FEN-1) in association with the processivity factor proliferating cell nuclear antigen (PCNA). DNA ligase I then seals the remaining nick in the DNA backbone and completes long-patch BER. Additional factors that may promote the BER pathway include: DNA glycosylase, APE1, Polb, Pold, Pole, XRCC1, Ligase III, FEN-1, PCNA, RECQL4, WRN, MYH, PNKP, and APTX.

Nucleotide Excision Repair (NER)

Nucleotide excision repair (NER) is an important excision mechanism that removes bulky helix-distorting lesions from DNA. Additional details about NER are given in Marteijn et al., NATURE REVIEWS MOLECULAR CELL BIOLOGY 15, 465-481 (2014), and a summary is given here. NER a broad pathway encompassing two smaller pathways: global genomic NER (GG-NER) and transcription coupled repair NER (TC-NER). GG-NER and TC-NER use different factors for recognizing DNA damage. However, they utilize the same machinery for lesion incision, repair, and ligation.

Once damage is recognized, the cell removes a short single-stranded DNA segment that contains the lesion. Endonucleases XPF/ERCC1 and XPG (encoded by ERCC5) remove the lesion by cutting the damaged strand on either side of the lesion, resulting in a single-strand gap of 22-30 nucleotides. Next, the cell performs DNA gap filling synthesis and ligation. Involved in this process are: PCNA, RFC, DNA Pol δ, DNA Pol ε or DNA Pol κ, and DNA ligase I or XRCC1/Ligase III. Replicating cells tend to use DNA pol ε and DNA ligase I, while non-replicating cells tend to use DNA Pol δ, DNA Pol κ, and the XRCC1/Ligase III complex to perform the ligation step.

NER can involve the following factors: XPA-G, POLH, XPF, ERCC1, XPA-G, and LIG1. Transcription-coupled NER (TC-NER) can involve the following factors: CSA, CSB, XPB, XPD, XPG, ERCC1, and TTDA. Additional factors that may promote the NER repair pathway include XPA-G, POLH, XPF, ERCC1, XPA-G, LIG1, CSA, CSB, XPA, XPB, XPC, XPD, XPF, XPG, TTDA, UVSSA, USP7, CETN2, RAD23B, UV-DDB, CAK subcomplex, RPA, and PCNA.

Interstrand Crosslink (ICL)

A dedicated pathway called the ICL repair pathway repairs interstrand crosslinks. Interstrand crosslinks, or covalent crosslinks between bases in different DNA strand, can occur during replication or transcription. ICL repair involves the coordination of multiple repair processes, in particular, nucleolytic activity, translesion synthesis (TLS), and HDR. Nucleases are recruited to excise the ICL on either side of the crosslinked bases, while TLS and HDR are coordinated to repair the cut strands. ICL repair can involve the following factors: endonucleases, e.g., XPF and RAD51C, endonucleases such as RAD51, translesion polymerases, e.g., DNA polymerase zeta and Rev1), and the Fanconi anemia (FA) proteins, e.g., FancJ.

Other Pathways

Several other DNA repair pathways exist in mammals.

Translesion synthesis (TLS) is a pathway for repairing a single stranded break left after a defective replication event and involves translesion polymerases, e.g., DNA polβ and Rev1.

Error-free postreplication repair (PRR) is another pathway for repairing a single stranded break left after a defective replication event.

Methods for Promoting Specific Repair Processes

Methods for promoting specific repair processes, e.g., preferentially over a different repair process, by utilizing a Cas9 molecule, at least one gRNA molecule, and a Trex2 molecule are described herein. In an embodiment, the Cas9 molecule has specific functional properties, e.g., a Cas9 molecule comprising nickase or double strand cleavage activity, and can promote one repair process in favor of another. In an aspect, the use of a combination of Cas9, at least one gRNA molecule, and a Trex2 molecule, described herein mediates, or preferentially promotes, one or more of the following repair processes: resection, canonical NHEJ, canonical HDR, ALT-HDR, ALT-NHEJ, or SSA.

As described above, resection plays an important role in canonical HDR, ALT-HDR, ALT-NHEJ, and SSA. In some embodiments, the repair process stimulated after Cas9-mediated cleavage is dependent upon the degree, e.g., the length, of resection. For example, SSA is stimulated only when the resection sufficiently exposes two direct repeat sequences competent for single strand annealing.

In an embodiment, the methods provided herein promote canonical HDR. In another embodiment, the methods provided herein promote alternative HDR. Canonical HDR or ALT-HDR requires the presence of a template nucleic acid. The template nucleic acid may be exogenous, e.g., provided to the cell or to the subject, or may be endogenous, e.g., naturally occurring in the cell or the subject. The template nucleic acid may be double stranded, single stranded, or nicked. Exemplary template nucleic acids are described herein. In an embodiment, where the template nucleic acid is double-stranded, canonical HDR is promoted. In an embodiment, where the template nucleic acid introduced is single-stranded or nicked, alternative HDR is promoted.

In an embodiment, the methods provided herein promote canonical NHEJ. In one embodiment, canonical NHEJ does not require the presence of a template nucleic acid. In another embodiment, the methods provided herein promote ALT-NHEJ. ALT-NHEJ does not require the presence of a template nucleic acid. In a further embodiment, the methods provided herein promote SSA. SSA does not require the presence of a template nucleic acid.

Combinations of Cas9 Molecules and a Trex2 Molecule

A Trex2 molecule, e.g., an endogenous or a heterologous Trex2 molecule, can be used in combination with different Cas9 molecules. For example, a Trex2 molecule, e.g., an endogenous or a heterologous Trex2 molecule, can be used in combination with an eiCas9 molecule, or in combination with an eaCas9 molecule, or in combination with two or more Cas9 molecules that may be eaCas9 molecules or eiCas9 molecules. In an embodiment where the combination comprises a Trex2 molecule, e.g., an endogenous or a heterologous Trex2 molecule, and two Cas9 molecules, the first and second Cas9 molecules are different, e.g., have different functional activity or have different amino acid sequences. In an embodiment where the combination comprises a Trex2 molecule, e.g., an endogenous or a heterologous Trex2 molecule, and more than two Cas9 molecules, the Cas9 molecules are also different.

In another embodiment, a Cas9 molecule may be used in combination with different Trex2 molecules. For example, a Cas9 molecule can be used in combination with one or more Trex2 molecules. In an embodiment where the combination comprises a Cas9 molecule and two or more Trex2 molecules, the Trex2 molecules are different, e.g., have different functional activity or have different amino acid sequences. Embodiments where two or more Cas9 molecules, e.g., three, four, five, six, seven or more Cas9 molecules, are used in combination with two or more Trex2 molecules, e.g., three, four, five, six, seven or more Trex2 molecules, are also envisioned.

In the methods where a cell is contacted with a combination comprising a Trex2 molecule, and two or more Cas9 molecules, e.g., an eiCas9 molecule and an eaCas9 molecule, the combination further comprises a gRNA corresponding to each of the Cas9 molecules in the combination. For example, in the combination of an eaCas9 molecule and an eiCas9 molecule, the combination further comprises two gRNA molecules, where the gRNA molecule that forms a complex with the eaCas9 molecule is only functional with the eaCas9 molecule, e.g., does not form a complex with the eiCas9 molecule. Similarly, the gRNA molecule that forms a complex with the eiCas9 molecule is only functional with the eiCas9 molecule, e.g., does not form a complex with the eaCas9 molecule. In an embodiment, the gRNA molecule that correspond to the eaCas9 molecule positions the eaCas9 molecule so that the cleavage event mediated by the eaCas9 molecule is at a preselected position on the target nucleic acid. In an embodiment, the gRNA molecule that corresponds to the eiCas9 molecule positions the eiCas9 away from the preselected position on the target nucleic acid, e.g., at least 10, 50, 100, 200, 300, 400, 500, 600, 700, 800, 900, or 1000 nucleotides from the preselected position, or within 10, 50, 100, 200, 300, 400, 500, 600, 700, 800, 900, or 1000 nucleotides of the preselected position. In an embodiment the amount of eiCas9 delivered is at least 2, 3, 4, 5, 10, 20, 30, 40, 50, or 100-fold higher than the amount of eaCas9 molecule that is delivered to the cell or the subject. Thus, in an embodiment, a plurality of eiCas9 molecules are localized to the target nucleic acid at varying or regular intervals on either or both sides of the preselected position at which the eaCas9 molecule-mediated cleavage event will occur. In an embodiment, a complex comprising the eiCas9 molecule and its gRNA, and a complex comprising the eaCas9 molecule and its gRNA, are contacted with, or administered to a cell.

Examples of gRNAs in Genome Editing Methods gRNA molecules as described herein can be used with Cas9 molecules that generate a double strand break or a single strand break to alter the sequence of a target nucleic acid, e.g., a target position or target genetic signature. In certain embodiments, the gRNA, e.g., a chimeric gRNA, is configured such that it comprises one or both of the gRNAs can position, e.g., when targeting a Cas9 molecule that makes single strand breaks, a single strand break within (i) 1-7 nucleotides of a target position, or (ii) sufficiently close that the target position is within the region of end resection.

In certain embodiments, the gRNAs are used with a Cas9 nickase molecule having RuvC activity, e.g., a Cas9 molecule having the HNH activity inactivated, e.g., a Cas9 molecule having a mutation at H840, e.g., the H840A mutation.

In certain embodiments, the gRNAs are used with a Cas9 nickase molecule having RuvC activity, e.g., a Cas9 molecule having the HNH activity inactivated, e.g., a Cas9 molecule having a mutation at N863, e.g., the N863A mutation.

Target Cells

A Cas9 molecule and/or a heterologous Trex2 molecule, and, optionally, one or both of at least one gRNA molecule, and a template nucleic acid, can be used to manipulate a cell, e.g., to edit a target nucleic acid, in a wide variety of cells.

In certain embodiments, a cell is manipulated by editing (e.g., introducing a mutation in) a target position in a gene of interest as described herein. In certain embodiments, the target position is modified in vivo. In other embodiments, the target position is modified ex vivo.

The Cas9 and gRNA molecules described herein can be delivered to a target cell. In certain embodiments, the target cell is a T cell, a CD8+ T cell, a CD8+ naïve T cell, a central memory T cell, an effector memory T cell, a CD4+ T cell, a stem cell memory T cell, a helper T cell, a regulatory T cell, a cytotoxic T cell, a natural killer T cell, a hematopoietic stem cell, a long term hematopoietic stem cell, a short term hematopoietic stem cell, a multipotent progenitor cell, a lineage restricted progenitor cell, a lymphoid progenitor cell, a pancreatic progenitor cell, an endocrine progenitor cell, an exocrine progenitor cell, a myeloid progenitor cell, a common myeloid progenitor cell, an erythroid progenitor cell, a megakaryocyte erythroid progenitor cell, a monocytic precursor cell, an endocrine precursor cell, an exocrine cell, a fibroblast, a hepatoblast, a myoblast, a macrophage, an islet beta-cell, a cardiomyocyte, a blood cell, a ductal cell, an acinar cell, an alpha cell, a beta cell, a delta cell, a PP cell, a cholangiocyte, a retinal cell, a photoreceptor cell, a rod cell, a cone cell, a retinal pigmented epithelium cell, a trabecular meshwork cell, a cochlear hair cell, an outer hair cell, an inner hair cell, a pulmonary epithelial cell, a bronchial epithelial cell, an alveolar epithelial cell, a pulmonary epithelial progenitor cell, a striated muscle cell, a cardiac muscle cell, a muscle satellite cell, a myocyte, a neuron, a neuronal stem cell, a mesenchymal stem cell, an induced pluripotent stem (iPS) cell, an embryonic stem cell, a monocyte, a megakaryocyte, a neutrophil, an eosinophil, a basophil, a mast cell, a reticulocyte, a B cell, e.g. a progenitor B cell, a Pre B cell, a Pro B cell, a memory B cell, a plasma B cell, a gastrointestinal epithelial cell, a biliary epithelial cell, a pancreatic ductal epithelial cell, an intestinal stem cell, a hepatocyte, a liver stellate cell, a Kupffer cell, an osteoblast, an osteoclast, an adipocyte (e.g., a brown adipocyte, or a white adipocyte), a preadipocyte, a pancreatic precursor cell, a pancreatic islet cell, a pancreatic beta cell, a pancreatic alpha cell, a pancreatic delta cell, a pancreatic exocrine cell, a Schwann cell, or an oligodendrocyte.

In certain embodiments, the target cell is a mammalian cell, e.g., a human cell, a mouse cell, a rat cell, a sheep cell, a cow cell, a pig cell, a horse cell, a goat cell, a dog cell or a cat cell. In one embodiment, the cell is a human cell.

In certain embodiments, a target cell is manipulated ex vivo by editing a nucleic acid at one or more target positions, then the target cell is administered to the subject. A suitable cell can also include a stem cell such as, by way of example, an embryonic stem cell, induced pluripotent stem cell, hematopoietic stem cell, or hemogenic endothelial (HE) cell (precursor to both hematopoietic stem cells and endothelial cells). In certain embodiments, the cell is an induced pluripotent stem cells (iPS) cell or a cell derived from an iPS cell, e.g., an iPS cell generated from the subject, modified using the methods disclosed herein and differentiated into a clinically relevant cell. In an embodiment, AAV is used to transduce the target cells, e.g., the target cells described herein.

In some embodiments, the cell is a cell from a disease-causing organism, e.g., a bacterium, fungus, protozoan, or parasite.

In some embodiments, the cell is situated in the body of a subject. In such instances, the cell might be the subject's own cells or might be cells of a disease-causing organism. In this case, a gRNA molecule, a Cas9 molecule, and/or a Trex2 molecule, and optionally a target nucleic acid, may be administered to the subject as pharmaceutical compositions. In some embodiments the subject is a mammal, e.g., a human, a farm animal (e.g., a cow, a pig, a horse, or a goat), or a companion animal (e.g., a dog or a cat).

In some embodiments, the subject suffers from a disease caused by a target position in a nucleic acid, e.g., a particular mutation, of a cell.

In some embodiments, the cell is a diseased or mutant-bearing cell. Such cells can be altered to treat the disease, e.g., to correct a mutation, or to alter the phenotype of the cell, or population of cells, e.g., to inhibit the growth of a cancer cell, e.g., a tumor. For example, a cell is associated with one or more diseases or conditions describe herein. In some embodiments, the cell is a cancer stem cell. In some embodiments, the cancer cell is selected from lung cancer cells, breast cancer cells, skin cancer cells, brain cancer cells, pancreatic cancer cells, hematopoietic cancer cells, liver cancer cells, kidney cancer cells, and ovarian cancer cells.

In some embodiments, the cell is characterized by a disorder caused by aberrant mtDNA. This disorder may be, e.g., a mtDNA depletion syndrome (e.g., Alpers or early infantile hepatocerebral syndromes) or a mtDNA deletion disorder (e.g., progressive external ophthalmoplegia (PEO), ataxia-neuropathy, or mitochondrial neurogastrointestinal encephalomyopathy (MNGIE)).

In some embodiments, the cell is a normal cell.

The cells may also be treated at a time when they are not situated in the body of a subject. In embodiments, a cell is treated ex vivo to avoid exposing a patient to an agent or agents that cause undesirable side effects. In embodiments, treating cells ex vivo allows a user to select a sub-population of cells to administer to the patient. The sub-population may be, e.g., cells having a nucleic acid that was successfully altered, or cells having a desired phenotype, such as minimal undesired alterations to DNA, or a phenotype that indicates the nucleic acid was successfully altered.

In some embodiments, the cell is not situated in a subject's body and the cell is modified for research or manufacturing purposes. In some embodiments, the cell is suitable for producing a recombinant biological product. For example, the cell can be a CHO cell or a fibroblast. In one embodiment, the cell is a cell that has been engineered to express a protein.

In some embodiments, the cell is actively dividing. In embodiments, the cell is in G2 phase.

The technology described herein can be used to edit numerous types of genomes, including plant genomes. The CRISPR/Cas system has been used for plant genome editing, as has been described in, e.g., Belhaj et al., PLANT METHODS 9:39, 2013. Accordingly, in certain embodiments, the cell is a plant cell, e.g., a monocot plant cell, or a dicot plant cell. In certain embodiments, the plant is a crop, e.g., a food crop. In certain embodiments, the plant is rice (e.g., *Orzya sativa*), maize (e.g., *Zea mays*), wheat (e.g., *Triticum aestivum*), soy (e.g., *Glycine max*), potato (e.g., *Solanum tuberosum*), a species of *Nicotiana*, a species of *Arabidopsis* e.g., *Arabidopsis thaliana*, cassava, sweet potato, sorghum, yam, plantain, or a citrus plant. In some embodiments, the plant is a pesticide-resistant plant, e.g., a plant that expresses one or more genes that confer resistance to a pesticide. In some embodiments, the plant is herbicide-resistant plant, e.g., a plant that expresses one or more genes that confer resistance to a herbicide. The herbicide may be, e.g., Roundup® (also known as glyphosate or N-(phosphonomethyl)glycine). In some embodiments, the plant produces a pesticide, e.g., Bt.

In some embodiments, the components used in the methods described herein (e.g., a Cas9 molecule, a Trex2 molecule, a gRNA, and/or a template nucleic acid) are introduced into the plant cell via protoplast transformation or agroinfiltration.

In some embodiments, after genome editing using the methods described herein, seeds are screened and a desired sub-population of seeds are selected. The sub-population may be, e.g., cells having a nucleic acid that was successfully altered, or cells having a desired phenotype such as minimal undesired alterations to DNA, or a phenotype that indicates the nucleic acid was successfully altered.

Cells produced by the methods described herein may be used immediately. Alternatively, the cells may be frozen (e.g., in liquid nitrogen) and stored for later use. The cells will usually be frozen in 10% dimethylsulfoxide (DMSO), 50% serum, 40% buffered medium, or some other such solution as is commonly used in the art to preserve cells at such freezing temperature and thawed in such a manner as commonly known in the art for thawing frozen cultured cells. Cells may also be thermostabilized for prolonged storage at 4° C.

Populations of cells can also be produced according to the methods described herein. These populations are distinguished from naturally occurring cells of the same type by the presence of targeted genomic edits or mutations produced using the methods described herein. In some cases, the edits may be relatively consistent from cell-to-cell, particularly if the population undergoes post-editing processing steps, such as purification or selection steps that result in the removal of unedited cells. In other cases, however, the edits or mutations are more variable in nature, occurring along a distribution, and the population of cells can be characterized by the particular distribution of edits therewithin.

Figure 23:
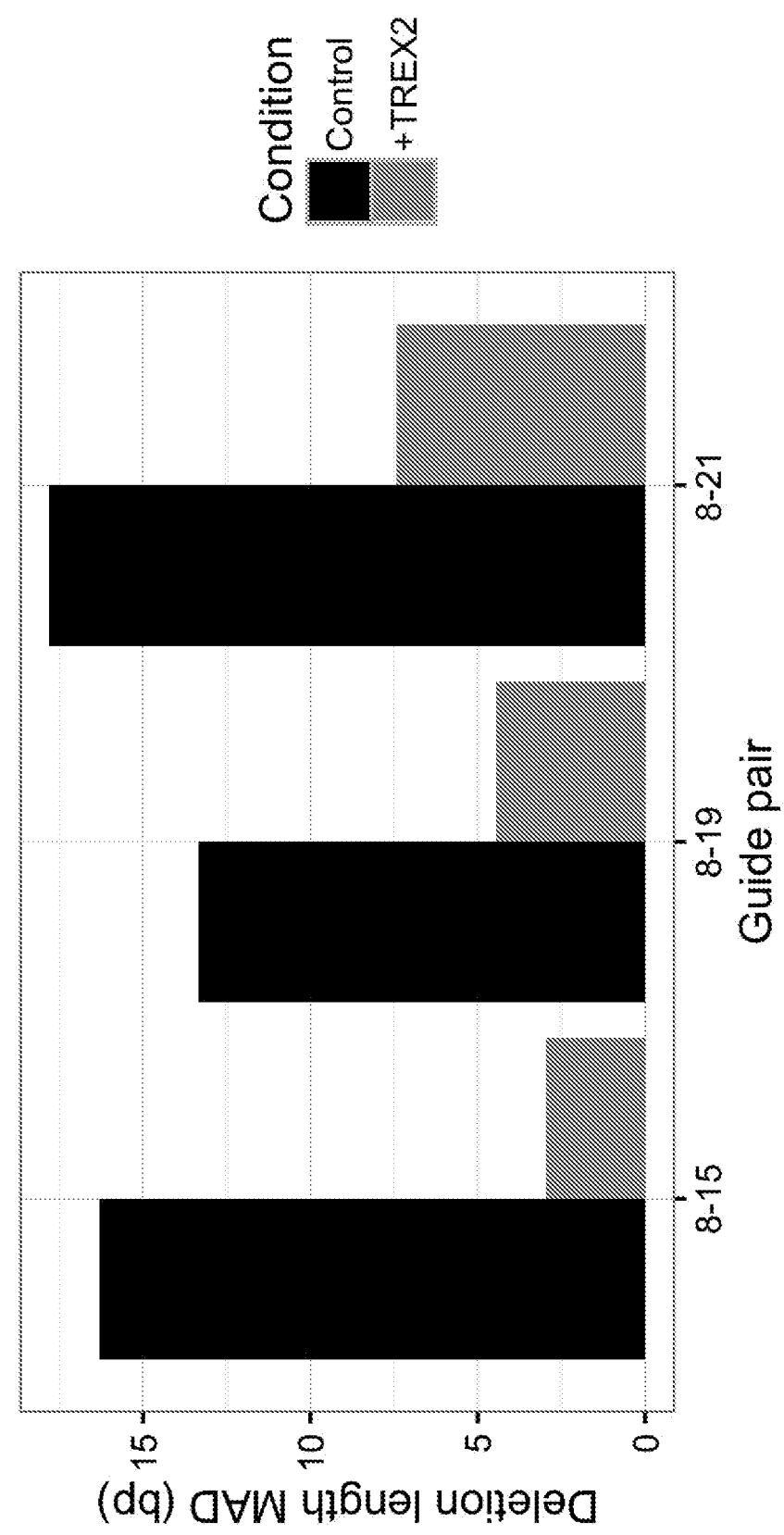
FIG. 23 depicts a comparison of the median absolute deviation (MAD) of the deletion length distribution for several gRNA pairs. For each gRNA pair, the bars show a comparison between the MAD of the deletion lengths in the presence (right, gray, "+TREX2") or absence (left, black, "Control") of ectopic Trex2 expression.

With specific reference to populations of cells bearing precise deletions produced according to the methods of this disclosure, the distributions of edits may have unique statistical characteristics. For example, in the case of cells edited using a paired nickase strategy (i.e., by introduction or expression of a first and a second gRNA and at least one nickase molecule), the use of an exogenous 3' to 5' exonuclease results in a distribution of deletions that is (a) centered on (i.e., has a mean or median within 5 bases of (a) the number of base pairs between the first single strand break and the second single strand break generated by the at least one nickase molecule, and (b) has a median absolute deviation (MAD) that is less than the MAD of a corresponding population edited using the same first and a second gRNA and at least one nickase molecule without the addition of exogenous 3' to 5' exonuclease (FIG. 23).

Delivery, Formulations, and Routes of Administration

The components, e.g., a Cas9 molecule, gRNA molecule (e.g., a Cas9 molecule/gRNA molecule complex), a Trex 2 molecule, and/or a donor template nucleic acid, can be delivered, formulated, or administered in a variety of forms, see, e.g., Tables 2 and 3. In certain embodiments, one Cas9 molecule and two or more (e.g., 2, 3, 4, or more) different gRNA molecules are delivered, e.g., by an AAV vector. In certain embodiments, the sequence encoding the Cas9 molecule and the sequence(s) encoding the two or more (e.g., 2, 3, 4, or more) different gRNA molecules are present on the same nucleic acid molecule, e.g., an AAV vector. When a Cas9 molecule and/or a Trex2 molecule or gRNA component is encoded as DNA for delivery, the DNA will typically but not necessarily include a control region, e.g., comprising a promoter, to effect expression. Useful promoters to drive the expression of nucleic acids encoding Cas9 and/or Trex2 sequences include CMV, SFFV, EFS, EF-1a, PGK, CAG, and CBH promoters. In an embodiment, the promoter is a constitutive promoter. In another embodiment, the promoter is a tissue specific promoter. Useful promoters for gRNAs include T7.H1, EF-1a, U6, U1, and tRNA promoters. Promoters with similar or dissimilar strengths can be selected to tune the expression of components. Sequences encoding a Cas9 molecule and/or a Trex2 molecule can comprise a nuclear localization signal (NLS), e.g., an SV40 NLS. In an embodiment, the sequence encoding a Cas9 molecule comprises at least two nuclear localization signals. In an embodiment, a promoter for a Cas9 molecule and/or a Trex2 molecule, or a gRNA molecule can be, independently, inducible, tissue specific, or cell specific.

Table 2 provides examples of how the components can be formulated, delivered, or administered.

TABLE 2

| Elements | | | | |
|---|---|---|---|---|
| Cas9 molecule(s) | Trex2 molecule(s) | gRNA molecule(s) | Donor Template Nucleic Acid | Comments |
| Protein | DNA | RNA | DNA | In an embodiment, a Cas9 molecule is provided as a protein, a Trex2 molecule is produced (i.e., via transcription/translation) from DNA, and a gRNA molecule is provided as in vitro transcribed or synthesized RNA. In this embodiment, the donor template is provided as a separate DNA molecule from the DNA molecule that encodes a Trex2 molecule. |
| Protein | DNA | RNA | DNA | In an embodiment, a Cas9 molecule is provided as a protein, a Trex2 molecule is produced (i.e., via transcription/translation) from DNA, and a gRNA molecule is provided as in vitro transcribed or synthesized RNA. In this embodiment, a Trex2 molecule is encoded by a DNA molecule that also provides the donor template. |
| Protein | Protein | RNA | DNA | In an embodiment, a Trex2 molecule and a Cas9 molecule are provided as proteins, and a gRNA molecule is provided as in vitro transcribed or synthesized RNA. In this embodiment, the donor template is provided as a DNA molecule. |
| Protein | DNA | DNA | DNA | In an embodiment, a Cas9 molecule is provided as a protein, a Trex2 molecule is produced (i.e., via transcription/translation) from DNA, and a gRNA molecule is transcribed from DNA. In this embodiment, a Trex2 and a gRNA molecule are encoded by separate DNA molecules. In this embodiment, the donor template is provided as a separate DNA molecule. |
| Protein | DNA | DNA | DNA | In an embodiment, a Cas9 molecule is provided as a protein, a Trex2 molecule is produced (i.e., via |

TABLE 2-continued

| | | Elements | | |
|---|---|---|---|---|
| Cas9 molecule(s) | Trex2 molecule(s) | gRNA molecule(s) | Donor Template Nucleic Acid | Comments |
| Protein | DNA | DNA | | transcription/translation) from DNA, and a gRNA molecule is transcribed from DNA. In this embodiment, a Trex2 and a gRNA molecule are encoded by the same DNA molecule. In this embodiment, the donor template is provided as a separate DNA molecule. |
| Protein | DNA | DNA | DNA | In an embodiment, a Cas9 molecule is provided as a protein, a Trex2 molecule is produced (i.e., via transcription/translation) from DNA, and a gRNA molecule is transcribed from DNA. In this embodiment, a gRNA molecule is encoded by the same DNA molecule that provides the donor template. In this embodiment, a Trex2 molecule is encoded by a separate DNA molecule. |
| Protein | DNA | DNA | DNA | In an embodiment, a Cas9 molecule is provided as a protein, a Trex2 molecule is produced (i.e., via transcription/translation) from DNA, and a gRNA molecule is transcribed from DNA. In this embodiment, a Trex2 molecule is encoded by the same DNA molecule that provides the donor template. In this embodiment, a gRNA molecule is encoded by a separate DNA molecule. |
| Protein | DNA | | DNA | In an embodiment, a Cas9 molecule is provided as a protein, a Trex2 molecule is produced (i.e., via transcription/translation) from DNA, and a gRNA molecule is transcribed from DNA. In this embodiment, a Trex2 molecule and a gRNA molecule are encoded by the same DNA molecule that provides the donor template. |
| Protein | Protein | DNA | DNA | In an embodiment, a Trex2 molecule and a Cas9 molecule are provided as proteins, and a gRNA molecule is transcribed from DNA. In this embodiment, a gRNA molecule is encoded by a DNA molecule that is separate from the DNA molecule that provides the donor template. |
| Protein | Protein | DNA | | In an embodiment, a Trex2 molecule and a Cas9 molecule are provided as proteins, and a gRNA molecule is transcribed from DNA. In this embodiment, a gRNA molecule is encoded by the same DNA molecule that provides the donor template. |

Table 3 summarizes various delivery methods for the components of a Cas system, e.g., the Cas9 molecule component and the gRNA molecule component, as described herein.

TABLE 3

| Delivery Vector/Mode | | Delivery into Non-Dividing Cells | Duration of Expression | Genome Integration | Type of Molecule Delivered |
|---|---|---|---|---|---|
| Physical (e.g., electroporation, particle gun, Calcium Phosphate transfection, cell compression or squeezing) | | YES | Transient | NO | Nucleic Acids and Proteins |
| Viral | Retrovirus | NO | Stable | YES | RNA |
| | Lentivirus | YES | Stable | YES/NO with modifications | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

DNA-Based Delivery of a Cas9 Molecule and/or a Trex2 Molecule and/or a gRNA Molecule Nucleic acids encoding Cas9 molecules (e.g., eaCas9 molecules) and/or Trex2 molecules, gRNA molecules, donor template nucleic acids, or any combination (e.g., two or all) thereof can be administered to subjects or delivered into cells by art-known methods or as described herein. For example, Cas9-encoding, Trex2-encoding and/or gRNA-encoding DNA, as well as donor template nucleic acids can be delivered by, e.g., vectors (e.g., viral or non-viral vectors), non-vector based methods (e.g., using naked DNA or DNA complexes), or a combination thereof.

Nucleic acids encoding Cas9 molecules (e.g., eaCas9 molecules) and/or Trex2 molecules and/or gRNA molecules can be conjugated to molecules (e.g., N-acetylgalactosamine) promoting uptake by the target cells. Donor template molecules can likewise be conjugated to molecules (e.g., N-acetylgalactosamine) promoting uptake by the target cells.

In some embodiments, the Cas9- and/or Trex2- and/or gRNA-encoding DNA is delivered by a vector, refererred to herein as a "gene editing vector system" (e.g., viral vector/virus or plasmid).

Vectors can comprise a sequence that encodes a Cas9 molecule and/or a Trex2 molecule and/or a gRNA molecule and/or a donor template with high homology to the region (e.g., target sequence) being targeted. In certain embodiments, the donor template comprises all or part of a target sequence. Exemplary donor templates are a repair template, e.g., a gene correction template, or a gene mutation template, e.g., point mutation (e.g., single nucleotide (nt) substitution) template). A vector can also comprise a sequence encoding a signal peptide (e.g., for nuclear localization, nucleolar localization, or mitochondrial localization), fused, e.g., to a Cas9 molecule and/or a Trex2 molecule. For example, the vectors can comprise a nuclear localization sequence (e.g., from SV40) fused to the sequence encoding the Cas9 molecule.

One or more regulatory/control elements, e.g., promoters, enhancers, introns, polyadenylation signals, Kozak consensus sequences, or internal ribosome entry sites (IRES), 2A sequences, and splice acceptors or donors can be included in the vectors. In some embodiments, the promoter is recognized by RNA polymerase II (e.g., a CMV promoter). In other embodiments, the promoter is recognized by RNA polymerase III (e.g., a U6 promoter). In some embodiments, the promoter is a regulated promoter (e.g., inducible promoter). In other embodiments, the promoter is a constitutive promoter. In some embodiments, the promoter is a tissue specific promoter. In some embodiments, the promoter is a viral promoter. In other embodiments, the promoter is a non-viral promoter.

In some embodiments, the vector is a viral vector (e.g., for generation of recombinant viruses). In some embodiments, the virus is a DNA virus (e.g., dsDNA or ssDNA virus). In other embodiments, the virus is an RNA virus (e.g., an ssRNA virus). In some embodiments, the virus infects dividing cells. In other embodiments, the virus infects non-dividing cells. Exemplary viral vectors/viruses include, e.g., retroviruses, lentiviruses, adenovirus, adeno-associated virus (AAV), vaccinia viruses, poxviruses, and herpes simplex viruses.

In some embodiments, the virus infects both dividing and non-dividing cells. In some embodiments, the virus can integrate into the host genome. In some embodiments, the virus is engineered to have reduced immunity, e.g., in human. In some embodiments, the virus is replication-competent. In other embodiments, the virus is replication-defective, e.g., having one or more coding regions for the genes necessary for additional rounds of virion replication and/or packaging replaced with other genes or deleted. In some embodiments, the virus causes transient expression of the Cas9 molecule and/or the Trex2 molecule and/or the gRNA molecule. In other embodiments, the virus causes long-lasting, e.g., at least 1 week, 2 weeks, 1 month, 2 months, 3 months, 6 months, 9 months, 1 year, 2 years, or permanent expression, of the Cas9 molecule and/or the Trex2 molecule and/or the gRNA molecule. The packaging capacity of the viruses may vary, e.g., from at least about 4 kb to at least about 30 kb, e.g., at least about 5 kb, 10 kb, 15 kb, 20 kb, 25 kb, 30 kb, 35 kb, 40 kb, 45 kb, or 50 kb.

In an embodiment, the viral vector recognizes a specific cell type or tissue. For example, the viral vector can be pseudotyped with a different/alternative viral envelope glycoprotein; engineered with a cell type-specific receptor (e.g., genetic modification(s) of one or more viral envelope glycoproteins to incorporate a targeting ligand such as a peptide ligand, a single chain antibody, or a growth factor); and/or engineered to have a molecular bridge with dual specificities with one end recognizing a viral glycoprotein and the other end recognizing a moiety of the target cell surface (e.g., a ligand-receptor, monoclonal antibody, avidin-biotin and chemical conjugation).

In some embodiments, the Cas9-, and/or Trex2-, gRNA- and/or template binding domain-encoding nucleic acid sequence is delivered by a recombinant retrovirus. In some embodiments, the retrovirus (e.g., Moloney murine leukemia virus) comprises a reverse transcriptase, e.g., that allows integration into the host genome. In some embodiments, the retrovirus is replication-competent. In other embodiments, the retrovirus is replication-defective, e.g., having one of more coding regions for the genes necessary for additional rounds of virion replication and packaging replaced with other genes, or deleted.

In some embodiments, the Cas9-, and/or Trex2-, gRNA- and/or template binding domain-encoding nucleic acid sequence is delivered by a recombinant lentivirus. In an embodiment, the donor template nucleic acid is delivered by a recombinant retrovirus. For example, the lentivirus is replication-defective, e.g., does not comprise one or more genes required for viral replication.

In an embodiment, the Cas9-, and/or Trex2-, and/or gRNA-encoding nucleic acid sequence is delivered by a recombinant lentivirus. In an embodiment, the donor template nucleic acid is delivered by a recombinant lentivirus. For example, the lentivirus is replication-defective, e.g., does not comprise one or more genes required for viral replication.

In some embodiments, the Cas9-, and/or Trex2- and/or gRNA-encoding nucleic acid sequence is delivered by a recombinant adenovirus. In an embodiment, the donor template nucleic acid is delivered by a recombinant adenovirus. In some embodiments, the adenovirus is engineered to have reduced immunity in human.

In some embodiments, the Cas9-, and/or Trex2- and/or gRNA-encoding nucleic acid sequence is delivered by a recombinant AAV. In an embodiment, the donor template nucleic acid is delivered by a recombinant AAV. In some embodiments, the AAV does not incorporate its genome into that of a host cell, e.g., a target cell as describe herein. In some embodiments, the AAV can incorporate its genome into that of the host cell. In some embodiments, the AAV is a self-complementary adeno-associated virus (scAAV), e.g., a scAAV that packages both strands which anneal together to form double stranded DNA.

In an embodiment, an AAV capsid that can be used in the methods described herein is a capsid sequence from serotype AAV1, AAV2, AAV3, AAV4, AAV5, AAV6, AAV7, AAV8, AAV9, AAV.rh8, AAV.rh10, AAV.rh32/33, AAV.rh43, AAV.rh64R1, or AAV7m8.

In an embodiment, the Cas9- and/or gRNA-encoding DNA is delivered in a re-engineered AAV capsid, e.g., with 50% or greater, e.g., 60% or greater, 70% or greater, 80% or greater, 90% or greater, or 95% or greater, sequence homology with a capsid sequence from serotypes AAV1, AAV2, AAV3, AAV4, AAV5, AAV6, AAV7, AAV8, AAV9, AAV.rh8, AAV.rh10, AAV.rh32/33, AAV.rh43, or AAV.rh64R1.

In an embodiment, the Cas9-, and/or Trex2- and/or gRNA-encoding DNA is delivered by a chimeric AAV capsid. In an embodiment, the donor template nucleic acid is delivered by a chimeric AAV capsid. Exemplary chimeric AAV capsids include, but are not limited to, AAV9i1, AAV2i8, AAV-DJ, AAV2G9, AAV2i8G9, or AAV8G9.

In an embodiment, the AAV is a self-complementary adeno-associated virus (scAAV), e.g., a scAAV that packages both strands which anneal together to form double stranded DNA.

In some embodiments, the Cas9-, and/or Trex2- and/or gRNA-encoding DNA is delivered by a hybrid virus, e.g., a hybrid of one or more of the viruses described herein. In an embodiment, the hybrid virus is hybrid of an AAV (e.g., of any AAV serotype), with a Bocavirus, B19 virus, porcine AAV, goose AAV, feline AAV, canine AAV, or MVM.

A packaging cell is used to form a virus particle that is capable of infecting a target cell. Exemplary packaging cells include 293 cells, which can package adenovirus, and ψ2 or PA317 cells, which can package retrovirus. A viral vector used in gene therapy is usually generated by a producer cell line that packages a nucleic acid vector into a viral particle. The vector typically contains the minimal viral sequences required for packaging and subsequent integration into a host or target cell (if applicable), with other viral sequences being replaced by an expression cassette encoding the protein to be expressed, e.g., Cas9 and/or Trex2. For example, an AAV vector used in gene therapy typically only possesses inverted terminal repeat (ITR) sequences from the AAV genome which are required for packaging and gene expression in the host or target cell. The missing viral functions can be supplied in trans by the packaging cell line and/or plasmid containing E2A, E4, and VA genes from adenovirus, and plasmid encoding Rep and Cap genes from AAV, as described in "Triple Transfection Protocol." Henceforth, the viral DNA is packaged in a cell line, which contains a helper plasmid encoding the other AAV genes, namely rep and cap, but lacking ITR sequences. In certain embodiments, the viral DNA is packaged in a producer cell line, which contains E1A and/or E1B genes from adenovirus. The cell line is also infected with adenovirus as a helper. The helper virus (e.g., adenovirus or HSV) or helper plasmid promotes replication of the AAV vector and expression of AAV genes from the helper plasmid with ITRs. The helper plasmid is not packaged in significant amounts due to a lack of ITR sequences. Contamination with adenovirus can be reduced by, e.g., heat treatment to which adenovirus is more sensitive than AAV.

In certain embodiments, the viral vector is capable of cell type and/or tissue type recognition. For example, the viral vector can be pseudotyped with a different/alternative viral envelope glycoprotein; engineered with a cell type-specific receptor (e.g., genetic modification of the viral envelope glycoproteins to incorporate targeting ligands such as a peptide ligand, single chain antibody, or growth factor); and/or engineered to have a molecular bridge with dual specificities with one end recognizing a viral glycoprotein and the other end recognizing a moiety of the target cell surface (e.g., ligand-receptor, monoclonal antibody, avidin-biotin and chemical conjugation).

In certain embodiments, the viral vector achieves cell type specific expression. For example, a tissue-specific promoter can be constructed to restrict expression of the transgene (Cas9, Trex2 and gRNA) to only the target cell. The specificity of the vector can also be mediated by microRNA-dependent control of transgene expression. In an embodiment, the viral vector has increased efficiency of fusion of the viral vector and a target cell membrane. For example, a fusion protein such as fusion-competent hemagglutinin (HA) can be incorporated to increase viral uptake into cells. In an embodiment, the viral vector has the ability of nuclear localization. For example, a virus that requires the breakdown of the nuclear envelope (during cell division) and therefore will not infect a non-diving cell can be altered to incorporate a nuclear localization peptide in the matrix protein of the virus thereby enabling the transduction of non-proliferating cells.

In some embodiments, the Cas9-, and/or Trex2- and/or gRNA-encoding DNA is delivered by a non-vector based method (e.g., using naked DNA or DNA complexes). For example, the DNA can be delivered, e.g., by organically modified silica or silicate (Ormosil), electroporation, transient cell compression or squeezing (see, e.g., Lee 2012), gene gun, sonoporation, magnetofection, lipid-mediated transfection, dendrimers, inorganic nanoparticles, calcium phosphates, or a combination thereof.

In an embodiment, delivery via electroporation comprises mixing the cells with the Cas9-, and/or Trex2-, and/or gRNA-encoding DNA in a cartridge, chamber or cuvette and applying one or more electrical impulses of defined duration and amplitude. In an embodiment, delivery via electroporation is performed using a system in which cells are mixed with the Cas9-, and/or Trex2-, and/or gRNA-encoding DNA in a vessel connected to a device (e.g., a pump) which feeds the mixture into a cartridge, chamber or cuvette wherein one or more electrical impulses of defined duration and amplitude are applied, after which the cells are delivered to a second vessel.

In some embodiments, the Cas9-, and/or Trex2-, and/or gRNA-encoding DNA is delivered by a combination of a vector and a non-vector based method. In an embodiment, the donor template nucleic acid is delivered by a combination of a vector and a non-vector based method. For example, virosomes combine liposomes with an inactivated virus (e.g., HIV or influenza virus), which can result in more efficient gene transfer, e.g., in respiratory epithelial cells than either viral or liposomal methods alone.

In certain embodiments, the delivery vehicle is a non-viral vector, and in certain of these embodiments the non-viral vector is an inorganic nanoparticle. Exemplary inorganic nanoparticles include, e.g., magnetic nanoparticles (e.g., $Fe_3MnO_2$) or silica. The outer surface of the nanoparticle can be conjugated with a positively charged polymer (e.g., polyethylenimine, polylysine, polyserine) which allows for attachment (e.g., conjugation or entrapment) of payload. In an embodiment, the non-viral vector is an organic nanoparticle (e.g., entrapment of the payload inside the nanoparticle). Exemplary organic nanoparticles include, e.g., SNALP liposomes that contain cationic lipids together with neutral helper lipids which are coated with polyethylene glycol (PEG) and protamine and nucleic acid complex coated with lipid coating.

Exemplary lipids for gene transfer are shown below in Table 4.

TABLE 4

Lipids Used for Gene Transfer

| Lipid | Abbreviation | Feature |
|---|---|---|
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)propyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N—(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |

TABLE 4-continued

Lipids Used for Gene Transfer

| Lipid | Abbreviation | Feature |
|---|---|---|
| rac-[2(2,3-Dihexadecyloxypropyl-oxymethyloxy)ethyl]trimethylammonium bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylphosphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Exemplary polymers for gene transfer are shown below in Table 5.

TABLE 5

Polymers Used for Gene Transfer

| Polymer | Abbreviation |
|---|---|
| Poly(ethylene)glycol | PEG |
| Polyethylenimine | PEI |
| Dithiobis(succinimidylpropionate) | DSP |
| Dimethyl-3,3'-dithiobispropionimidate | DTBP |
| Poly(ethylene imine) biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amido ethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

In an embodiment, the vehicle has targeting modifications to increase target cell update of nanoparticles and liposomes, e.g., cell specific antigens, monoclonal antibodies, single chain antibodies, aptamers, polymers, sugars (e.g., N-acetyl-galactosamine (GalNAc)), and cell penetrating peptides. In an embodiment, the vehicle uses fusogenic and endosome-destabilizing peptides/polymers. In an embodiment, the vehicle undergoes acid-triggered conformational changes (e.g., to accelerate endosomal escape of the cargo). In an embodiment, a stimuli-cleavable polymer is used, e.g., for release in a cellular compartment. For example, disulfide-based cationic polymers that are cleaved in the reducing cellular environment can be used.

In an embodiment, the delivery vehicle is a biological non-viral delivery vehicle. In an embodiment, the vehicle is an attenuated bacterium (e.g., naturally or artificially engineered to be invasive but attenuated to prevent pathogenesis and expressing the transgene (e.g., Listeria monocytogenes, certain Salmonella strains, Bifidobacterium longum, and modified Escherichia coli), bacteria having nutritional and tissue-specific tropism to target specific tissues, bacteria having modified surface proteins to alter target tissue specificity). In an embodiment, the vehicle is a genetically modified bacteriophage (e.g., engineered phages having large packaging capacity, less immunogenic, containing mammalian plasmid maintenance sequences and having incorporated targeting ligands). In an embodiment, the vehicle is a mammalian virus-like particle. For example, modified viral particles can be generated (e.g., by purification of the "empty" particles followed by ex vivo assembly of the virus with the desired cargo). The vehicle can also be engineered to incorporate targeting ligands to alter target tissue specificity. In an embodiment, the vehicle is a biological liposome. For example, the biological liposome is a phospholipid-based particle derived from human cells, or secretory exosomes-subject (i.e., patient) derived membrane-bound nanovesicle (30-100 nm) of endocytic origin (e.g., can be produced from various cell types and can therefore be taken up by cells without the need of for targeting ligands).

In an embodiment, one or more nucleic acid molecules (e.g., DNA molecules or template nucleic acids) other than the components of a Cas system, e.g., the Cas9 molecule component, and/or the Trex2 molecule component, and/or the gRNA molecule component described herein, are delivered. In an embodiment, the nucleic acid molecule is delivered at the same time as one or more of the components of the Cas system are delivered. In an embodiment, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Cas system are delivered. In an embodiment, the nucleic acid molecule is delivered by a different means than one or more of the components of the Cas system, e.g., the Cas9 molecule component, and/or the Trex2 molecule component, and/or the gRNA molecule component, are delivered. The nucleic acid molecule can be delivered by any of the delivery methods described herein. For example, the nucleic acid molecule can be delivered by a viral vector, e.g., an integration-deficient lentivirus, and the Cas9 molecule component, and/or the Trex2 molecule component, and/or the gRNA molecule component can be delivered by electroporation, e.g., such that the toxicity caused by nucleic acids (e.g., DNAs) can be reduced. In an embodiment, the nucleic acid molecule encodes a protein, e.g., a Cas9 molecule or a Trex2 molecule, as described herein. In an embodiment, the nucleic acid molecule encodes an RNA molecule, e.g., an RNA molecule described herein. In an embodiment, the nucleic acid is a template nucleic acid capable of participating in HDR.

Delivery of RNA Encoding a Trex2 Molecule

RNA encoding Trex2 molecules, and/or gRNA molecules, can be delivered into cells, e.g., target cells described herein, by art-known methods or as described herein. For example, Trex2-encoding and/or gRNA-encoding RNA can be delivered, e.g., by microinjection, electroporation, transient cell compression or squeezing (see, e.g., Lee et al. Nano Lett. 12(12):6322-6327 (2012)), lipid-mediated transfection, peptide-mediated delivery, or a combination thereof. Trex2-encoding, and/or gRNA-encoding RNA can be conjugated to molecules) promoting uptake by the target cells (e.g., target cells described herein). Delivery can also be accompanied by a donor template nucleic acid.

In an embodiment, delivery via electroporation comprises mixing the cells with the RNA encoding Trex2 molecules and/or gRNA molecules, with or without donor template nucleic acid molecules, in a cartridge, chamber or cuvette and applying one or more electrical impulses of defined duration and amplitude. In an embodiment, delivery via electroporation is performed using a system in which cells are mixed with the RNA encoding Trex2 molecules and/or gRNA molecules, with or without donor template nucleic acid molecules in a vessel connected to a device (e.g., a pump) which feeds the mixture into a cartridge, chamber or cuvette wherein one or more electrical impulses of defined duration and amplitude are applied, after which the cells are delivered to a second vessel. Trex2-encoding and/or gRNA-encoding RNA can be conjugated to molecules to promote uptake by the target cells (e.g., target cells described herein).

Delivery of Cas9 and/or Trex2 Protein

Cas9 and/or Trex2 molecules can be delivered into cells by art-known methods or as described herein. For example, Cas9 and/or Trex2 protein molecules can be delivered, e.g., by microinjection, electroporation, transient cell compression or squeezing (see, e.g., Lee 2012), lipid-mediated transfection, peptide-mediated delivery, or a combination thereof. Delivery can be accompanied by DNA encoding a gRNA or by a gRNA. Cas9 and/or Trex2 protein can be conjugated to molecules promoting uptake by the target cells (e.g., target cells described herein). Delivery can be accompanied by DNA encoding a gRNA or by a gRNA. Delivery can also be accompanied by a donor template nucleic acid.

In an embodiment, delivery via electroporation comprises mixing the cells with the Cas9 molecules and/or the Trex2 molecules and/or gRNA molecules, with or without donor nucleic acid, in a cartridge, chamber or cuvette and applying one or more electrical impulses of defined duration and amplitude. In an embodiment, delivery via electroporation is performed using a system in which cells are mixed with the Cas9 molecules and/or the Trex2 molecules and/or gRNA molecules, with or without donor nucleic acid in a vessel connected to a device (e.g., a pump) which feeds the mixture into a cartridge, chamber or cuvette wherein one or more electrical impulses of defined duration and amplitude are applied, after which the cells are delivered to a second vessel. Cas9-encoding, and/or Trex2-encoding, and/or gRNA-encoding RNA can be conjugated to molecules to promote uptake by the target cells (e.g., target cells described herein). Based on the teachings described herein, a skilled artisan could optimize the delivery of Cas9 and/or Trex2 protein molecules into target cells.

Route of Administration

Systemic modes of administration include oral and parenteral routes. Parenteral routes include, by way of example, intravenous, inhalation, intramarrow, intrarterial, intraosseous, intramuscular, intradermal, subcutaneous, intranasal, and intraperitoneal routes. Components administered systemically may be modified or formulated to target the components to the desired cell type.

Local modes of administration include, by way of example, intrathecal, intracerebroventricular, intraparenchymal (e.g., localized intraparenchymal delivery to the striatum (e.g., into the caudate or into the putamen)), cerebral cortex, precentral gyrus, hippocampus (e.g., into the dentate gyrus or CA3 region), temporal cortex, amygdala, frontal cortex, thalamus, cerebellum, medulla, hypothalamus, tectum, tegmentum or substantia nigra intraocular, intraorbital, subconjuctival, intravitreal, subretinal or transscleral routes. In an embodiment, significantly smaller amounts of the components (compared with systemic approaches) may exert an effect when administered locally (for example, intraparenchymal or intravitreal) compared to when administered systemically (for example, intravenously). Local modes of administration can reduce or eliminate the incidence of potentially toxic side effects that may occur when therapeutically effective amounts of a component are administered systemically.

Administration may be provided as a periodic bolus (for example, intravenously) or as continuous infusion from an internal reservoir or from an external reservoir (for example, from an intravenous bag or implantable pump). Components may be administered locally, for example, by continuous release from a sustained release drug delivery device.

In addition, components may be formulated to permit release over a prolonged period of time. A release system can include a matrix of a biodegradable material or a material which releases the incorporated components by diffusion. The components can be homogeneously or heterogeneously distributed within the release system. A variety of release systems may be useful, however, the choice of the appropriate system will depend upon rate of release required by a particular application. Both non-degradable and degradable release systems can be used. Suitable release systems include polymers and polymeric matrices, non-polymeric matrices, or inorganic and organic excipients and diluents such as, but not limited to, calcium carbonate and sugar (for example, trehalose). Release systems may be natural or synthetic. However, synthetic release systems are preferred because generally they are more reliable, more reproducible and produce more defined release profiles. The release system material can be selected so that components having different molecular weights are released by diffusion through or degradation of the material.

Representative synthetic, biodegradable polymers include, for example: polyamides such as poly(amino acids) and poly(peptides); polyesters such as poly(lactic acid), poly(glycolic acid), poly(lactic-co-glycolic acid), and poly(caprolactone); poly(anhydrides); polyorthoesters; polycarbonates; and chemical derivatives thereof (substitutions, additions of chemical groups, for example, alkyl, alkylene, hydroxylations, oxidations, and other modifications routinely made by those skilled in the art), copolymers and mixtures thereof. Representative synthetic, non-degradable polymers include, for example: polyethers such as poly (ethylene oxide), poly(ethylene glycol), and poly(tetramethylene oxide); vinyl polymers-polyacrylates and polymethacrylates such as methyl, ethyl, other alkyl, hydroxyethyl methacrylate, acrylic and methacrylic acids, and others such as poly(vinyl alcohol), poly(vinyl pyrolidone), and poly (vinyl acetate); poly(urethanes); cellulose and its derivatives such as alkyl, hydroxyalkyl, ethers, esters, nitrocellulose, and various cellulose acetates; polysiloxanes; and any chemical derivatives thereof (substitutions, additions of chemical groups, for example, alkyl, alkylene, hydroxylations, oxidations, and other modifications routinely made by those skilled in the art), copolymers and mixtures thereof.

Poly(lactide-co-glycolide) microsphere can also be used. Typically the microspheres are composed of a polymer of lactic acid and glycolic acid, which are structured to form hollow spheres. The spheres can be approximately 15-30 microns in diameter and can be loaded with components described herein.

Bi-Modal or Differential Delivery of Components

Separate delivery of the components of a Cas system, e.g., the Cas9 molecule component, the Trex2 molecule component, the gRNA molecule component, and/or the template nucleic acid, and more particularly, delivery of the components by differing modes, can enhance performance, e.g., by improving tissue specificity and safety.

In an embodiment, the Cas9 molecule, the Trex2 molecule, the gRNA molecule and/or the template nucleic acid are delivered by different modes, or as sometimes referred to herein as differential modes. Different or differential modes as used herein refer modes of delivery that confer different pharmacodynamic or pharmacokinetic properties on the subject component molecule, e.g., a Cas9 molecule, and/or a Trex2 molecule, and/or a gRNA molecule, and/or template nucleic acid, or payload. For example, the modes of delivery can result in different tissue distribution, different half-life, or different temporal distribution, e.g., in a selected compartment, tissue, or organ. In many embodiments, the components are delivered so that one or more of, e.g., all of, a Cas9 molecule, a Trex2 molecule, a gRNA molecule, and template nucleic acid will be present in the same cell at the same time.

In an embodiment, two gRNAs are delivered to a cell so that a first nickase will make a first single stranded break and a second nickase will make a second single stranded break. In such embodiments, the two gRNAs and other components (e.g., the Cas9 molecule) are delivered such that the two breaks are made at substantially the same time. In an embodiment, this comprises the second break being formed before the first break engages with machinery specific to the SSBR (single stranded break repair) pathway, and in an embodiment, it comprises the second break being formed before the first break is repaired. More generally, when one desires to make two or more breaks in a target nucleic acid, the gRNAs and other components can be delivered such that the two or more breaks are made at substantially the same time.

Some modes of delivery, e.g., delivery by a nucleic acid vector that persists in a cell, or in progeny of a cell, e.g., by autonomous replication or insertion into cellular nucleic acid, result in more persistent expression of and presence of a component. Examples include viral, e.g., AAV or lentivirus, delivery.

By way of example, the components, e.g., a Cas9 molecule, a Trex2 molecule, a gRNA molecule, and template nucleic acid can be delivered by modes that differ in terms of resulting half-life or persistent of the delivered component the body, or in a particular compartment, tissue or organ. In an embodiment, one ore both of, e.g., all of, a gRNA molecule and a template nucleic acid can be delivered by such modes. The Cas9 molecule and/or the Trex2 molecule components can be delivered by a mode which results in less persistence or less exposure to the body or a particular compartment or tissue or organ.

More generally, in an embodiment, a first mode of delivery is used to deliver a first component and a second mode of delivery is used to deliver a second component. The first mode of delivery confers a first pharmacodynamic or pharmacokinetic property. The first pharmacodynamic property can be, e.g., distribution, persistence, or exposure, of the component, or of a nucleic acid that encodes the component, in the body, a compartment, tissue or organ. The second mode of delivery confers a second pharmacodynamic or pharmacokinetic property. The second pharmacodynamic property can be, e.g., distribution, persistence, or exposure, of the component, or of a nucleic acid that encodes the component, in the body, a compartment, tissue or organ.

In certain embodiments, the first pharmacodynamic or pharmacokinetic property, e.g., distribution, persistence or exposure, is more limited than the second pharmacodynamic or pharmacokinetic property.

In certain embodiments, the first mode of delivery is selected to optimize, e.g., minimize, a pharmacodynamic or pharmacokinetic property, e.g., distribution, persistence or exposure.

In certain embodiments, the second mode of delivery is selected to optimize, e.g., maximize, a pharmacodynamic or pharmacokinetic property, e.g., distribution, persistence or exposure.

In certain embodiments, the first mode of delivery comprises the use of a relatively persistent element, e.g., a nucleic acid, e.g., a plasmid or viral vector, e.g., an AAV or lentivirus. As such vectors are relatively persistent product transcribed from them would be relatively persistent.

In certain embodiments, the second mode of delivery comprises a relatively transient element, e.g., an RNA or protein.

In certain embodiments, the first component comprises gRNA or template nucleic acid, and the delivery mode is relatively persistent, e.g., the gRNA is transcribed from a plasmid or viral vector, e.g., an AAV or lentivirus. Transcription of these genes would be of little physiological consequence because the genes do not encode for a protein product, and the gRNAs are incapable of acting in isolation. The second component, a Cas9 molecule, in combination with a Trex2 molecule, is delivered in a transient manner, for example as mRNA or as protein, ensuring that all components are present and active for a short period of time.

Furthermore, the components can be delivered in different molecular form or with different delivery vectors that complement one another to enhance safety and tissue specificity.

Use of differential delivery modes can enhance performance, safety, and/or efficacy, e.g., the likelihood of an eventual off-target modification can be reduced. Delivery of immunogenic components, e.g., Cas9 molecules and/or Trex2 molecules, by less persistent modes can reduce immunogenicity, as peptides from e.g., a bacteria-derived proteins, e.g., a bacteria-derived Cas9 molecule or from a bacteria-derived Trex2 molecule, are displayed on the surface of the cell by MHC molecules. A two-part delivery system can alleviate these drawbacks.

Differential delivery modes can be used to deliver components to different, but overlapping target regions. The formation active complex is minimized outside the overlap of the target regions. Thus, in an embodiment, a first component, e.g., a gRNA molecule is delivered by a first delivery mode that results in a first spatial, e.g., tissue, distribution. A second component, e.g., a Cas9 molecule in combination with a Trex2 molecule, is delivered by a second delivery mode that results in a second spatial, e.g., tissue, distribution. In an embodiment the first mode comprises a first element selected from a liposome, nanoparticle, e.g., polymeric nanoparticle, and a nucleic acid, e.g., viral vector. The second mode comprises a second element selected from the group. In an embodiment, the first mode of delivery comprises a first targeting element, e.g., a cell specific receptor or an antibody, and the second mode of delivery does not include that element. In certain embodiments, the second mode of delivery comprises a second targeting element, e.g., a second cell specific receptor or second antibody.

When the Cas9 molecules and the Trex2 molecules are delivered in a virus delivery vector, a liposome, or polymeric nanoparticle, there is the potential for delivery to and therapeutic activity in multiple tissues, when it may be desirable to only target a single tissue. A two-part delivery system can resolve this challenge and enhance tissue specificity. If the gRNA molecule and the Cas9/Trex2 molecules (e.g., nucleic acids encoding a Cas9 molecule are packaged in separated delivery vehicles with distinct but overlapping tissue tropism, the fully functional complex is only be formed in the tissue that is targeted by both vectors.

In one embodiment, administration of the first pre-formed complex and the second pre-formed complex occur sequentially. In another embodiment, administration of the first pre-formed complex and the second pre-formed complex occur simultaneously.

Ex Vivo Delivery

In some embodiments, components described above are introduced into cells which are then introduced into the subject. Methods of introducing the components can include, e.g., any of the delivery methods described herein.

In an embodiment, the cells are contacted with a Cas9 molecule in combination with a Trex2 molecule (or nucleic acid(s) encoding the same) ex vivo. In an embodiment, the cells are contacted with a gRNA (or a nucleic acid encoding the same) ex vivo. In some embodiment, the cells are contacted with a template nucleic acid ex vivo. In an embodiment, the cells are contacted with two or all of the preceding compositions (or nucleic acids encoding the same) ex vivo. In an embodiment, the cells are contacted with one or more of the preceding components (or nucleic acids encoding the same), and one or more remaining components are administered to the patient.

Modified Nucleosides, Nucleotides, and Nucleic Acids

Modified nucleosides and modified nucleotides can be present in nucleic acids, e.g., particularly gRNA, but also other forms of RNA, e.g., mRNA, RNAi, or siRNA. As described herein, "nucleoside" is defined as a compound containing a five-carbon sugar molecule (a pentose or ribose) or derivative thereof, and an organic base, purine or pyrimidine, or a derivative thereof. As described herein, "nucleotide" is defined as a nucleoside further comprising a phosphate group.

Modified nucleosides and nucleotides can include one or more of:
(i) alteration, e.g., replacement, of one or both of the non-linking phosphate oxygens and/or of one or more of the linking phosphate oxygens in the phosphodiester backbone linkage;
(ii) alteration, e.g., replacement, of a constituent of the ribose sugar, e.g., of the 2' hydroxyl on the ribose sugar;
(iii) wholesale replacement of the phosphate moiety with "dephospho" linkers;
(iv) modification or replacement of a naturally occurring nucleobase;
(v) replacement or modification of the ribose-phosphate backbone;
(vi) modification of the 3' end or 5' end of the oligonucleotide, e.g., removal, modification or replacement of a terminal phosphate group or conjugation of a moiety; and
(vii) modification of the sugar.

The modifications listed above can be combined to provide modified nucleosides and nucleotides that can have two, three, four, or more modifications. For example, a modified nucleoside or nucleotide can have a modified sugar and a modified nucleobase. In an embodiment, every base of a gRNA, a template domain binding partner, or template nucleic acid is modified, e.g., all bases have a modified phosphate group, e.g., all are phosphorothioate groups. In an embodiment, all, or substantially all, of the phosphate groups of a unimolecular (or chimeric) or modular gRNA molecule, or template nucleic acid are replaced with phosphorothioate groups.

In an embodiment, modified nucleotides, e.g., nucleotides having modifications as described herein, can be incorporated into a nucleic acid, e.g., a "modified nucleic acid." In an embodiment, the modified nucleic acids comprise one, two, three or more modified nucleotides. In an embodiment, at least 5% (e.g., at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%) of the positions in a modified nucleic acid are a modified nucleotides.

Unmodified nucleic acids can be prone to degradation by, e.g., cellular nucleases. For example, nucleases can hydrolyze nucleic acid phosphodiester bonds. Accordingly, in one aspect the modified nucleic acids described herein can contain one or more modified nucleosides or nucleotides, e.g., to introduce stability toward nucleases.

In an embodiment, the modified nucleosides, modified nucleotides, and modified nucleic acids described herein can exhibit a reduced innate immune response when introduced into a population of cells, both in vivo and ex vivo. The term "innate immune response" includes a cellular response to exogenous nucleic acids, including single stranded nucleic acids, generally of viral or bacterial origin, which involves the induction of cytokine expression and release, particularly the interferons, and cell death. In an embodiment, the modified nucleosides, modified nucleotides, and modified nucleic acids described herein can disrupt binding of a major groove interacting partner with the nucleic acid. In an embodiment, the modified nucleosides, modified nucleotides, and modified nucleic acids described herein can exhibit a reduced innate immune response when introduced into a population of cells, both in vivo and ex vivo, and also disrupt binding of a major groove interacting partner with the nucleic acid.

In an embodiment, a template nucleic acid comprises modifications, e.g., modified nucleotides, modifications to the backbone, and other modifications described herein. In an embodiment, the modification improves the stability of the template nucleic acid, e.g., by increasing its resistance to endonucleases and/or exonucleases.

In an embodiment, a template nucleic acid that comprises modifications is double stranded, e.g., is double stranded DNA. In some such embodiments, all the modifications are confined to one strand. In an embodiment, modifications are present on both strands. Modifications may be present in the 5' homology arm, the 3' homology arm, or the replacement sequence, or any combination thereof. In an embodiment, modifications are present in one or both homology arms but not the replacement sequence.

In an embodiment, a template nucleic acid that comprises modifications is single stranded, e.g., is single stranded DNA.

miRNA Binding Sites microRNAs (or miRNAs) are naturally occurring cellular 19-25 nucleotide long noncoding RNAs. They bind to nucleic acid molecules having an appropriate miRNA binding site, e.g., in the 3' UTR of an mRNA, and down-regulate gene expression. While not wishing to be bound by theory, it is believed that this down regulation occurs by either reducing nucleic acid molecule stability or inhibiting translation. An RNA species disclosed herein, e.g., an mRNA encoding Cas9, can comprise an miRNA binding site, e.g., in its 3'UTR. The miRNA binding site can be selected to promote down regulation of expression is a selected cell type.

Methods of Treatment

A genetic disease is caused by a mutation in the patient's genome. Often, the mutation results in a change in a protein, e.g., an amino acid substitution or a truncation. Genetic diseases can be dominant, i.e., one mutant gene is sufficient to cause the disease, or recessive, where a patient with one copy of the mutant gene is an asymptomatic carrier, and two copies of the mutant gene are necessary for the disease to result.

Disclosed herein are the approaches to treat or prevent genetic diseases, using the compositions and methods described herein.

One approach to treat or prevent genetic diseases is to repair (i.e., correct) one or more mutations in the disease-causing gene by HDR. In this approach, mutant allele(s) are corrected and restored to wild type state. While not wishing to be bound by theory, it is believed that correction of the mutation to the corresponding wild-type sequence restores wild type protein production within the relevant cell type. The method described herein can be performed in all cell types.

In an embodiment, one mutant allele is repaired in the subject. For example, in a patient with an autosomal dominant genetic disease, the sole mutant allele in the cell is corrected so that the cell becomes wild-type at both loci. As another example, in a patient with an autosomal recessive genetic disease, one of the two mutant alleles in the cell is corrected, and so the cell becomes heterozygous, which is sufficient for normal functioning. As a recessive genetic disease only displays a phenotype when both alleles are mutated, repair of a single allele is adequate for a cure. In another embodiment, both mutant alleles are repaired in the subject. In either situation, the subjects can be cured of disease.

Correction of a mutation in the relevant gene may be performed prior to disease onset (e.g., prior to the appearance of symptoms) or after disease onset, for instance, early in the disease course.

In an embodiment, the method comprises initiating treatment of a subject prior to disease onset. In an embodiment, the method comprises initiating treatment of a subject after disease onset. In an embodiment, the method comprises initiating treatment of a subject well after disease onset, e.g., 1, 2, 3, 4, 5, 6, 7, 8, 9, 10, 12, 24, or 36 months after onset of the disease. While not wishing to be bound by theory it is believed that this may be effective if subjects did not present to physician until well into the course of illness. In an embodiment, the method comprises initiating treatment of a subject in an advanced stage of disease.

Overall, initiation of treatment for subjects at all stages of disease is expected to prevent negative consequences of disease and be of benefit to subjects.

In an embodiment, the method comprises initiating treatment of a subject prior to disease expression. In an embodiment, the method comprises initiating treatment of a subject in an early stage of disease, e.g., when a subject has tested positive for the disease but has no signs or symptoms associated with the disease.

In an embodiment, the method comprises initiating treatment of a subject who has tested positive for the mutation underlying the disease, based on diagnosis via electrophoresis, genotyping, family history or other diagnostic criteria.

EXAMPLES

The following Examples are merely illustrative and are not intended to limit the scope or content of the invention in any way.

Example 1: Trex2 Modulates DNA Repair Outcomes in the Context of Different Cas9 Variants The CRISPR/Cas9 system was used to target the human HBB gene in the region of the sickle cell anemia-causing mutation.

The nature of the targeted break affects the frequency of different DNA repair outcomes. Blunt double-strand breaks, single-strand nicks, and dual-nicks in which the nicks are placed on opposite strands and leave either 3' or 5' overhangs of varying lengths, were introduced by utilizing the wild type Cas9 nuclease, as well as two different Cas9 nickases (i.e., D10A Cas9 nickase or N863A Cas9 nickase). There are several different DNA repair outcomes including, e.g., indel mutations resulting from non-homologous end-joining. The frequency of indels under different conditions offers insight into the mechanisms of DNA repair and how it is impacted by the nature of the DNA break.

Here, by ectopically expressing an enzyme that acts on the various DNA substrates induced by the different Cas9 variants, DNA repair outcomes can be modulated, including indel frequency and size.

As an example for the ectopic expression of end-processing enzymes, the effects of Trex2, a 3'-5' exonuclease, on lesions induced by different Cas9 variants were examined. First, the effect of expression of Trex2 on the modification profile of WT-Cas9-induced DNA lesions was determined (FIG. 1). U2OS cells were electroporated with 250 ng of plasmid encoding either gRNA 8 or gRNA 15, 750 ng of wild type Cas9 plasmid, and 500 ng of a plasmid encoding the enzyme Trex2. "gRNA 8" has the targeting domain sequence GUAACGGCAGACUUCUCCUC (SEQ ID NO: 251) and "gRNA 15" has the targeting domain sequence AAGGUGAACGUGGAUGAAGU (SEQ ID NO: 252). gRNAs 8 and 15 target opposite DNA strands in a "PAM-out" orientation.

Figure 2:
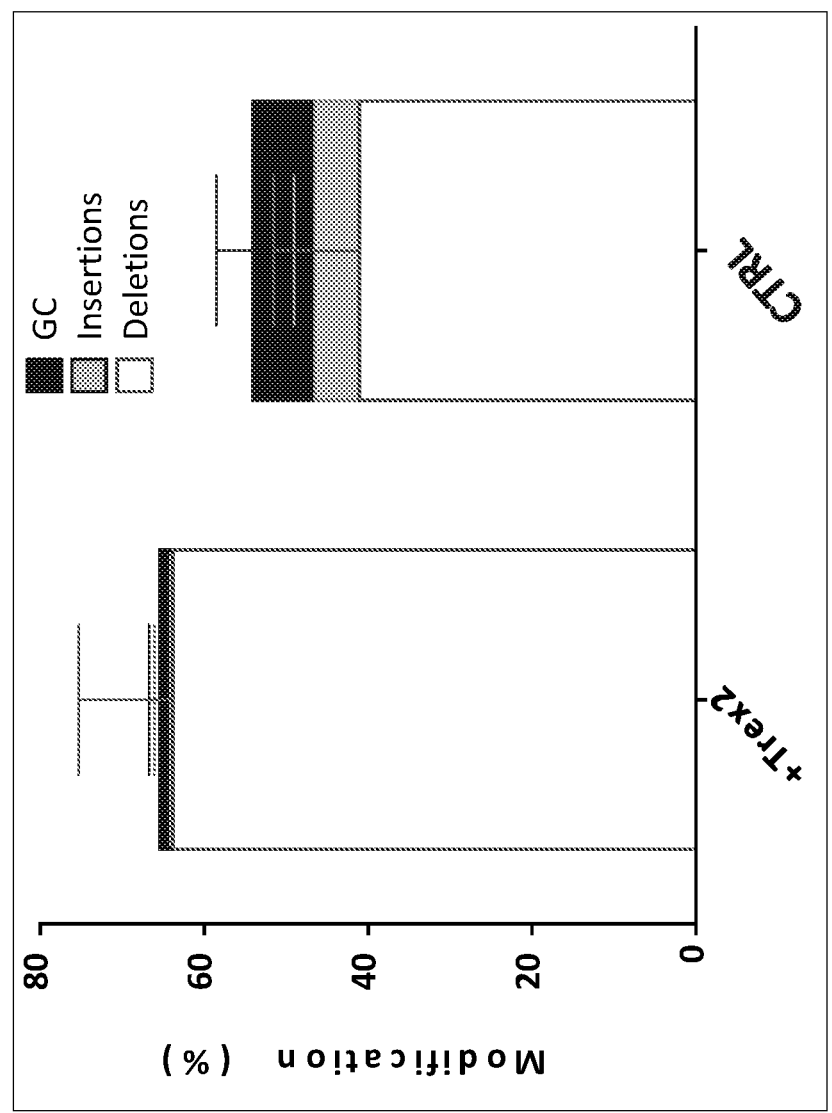
FIG. 2 is a graph depicting the frequency of editing outcomes at the HBB locus observed in the presence (+Trex2) or absence (CTRL) of ectopic Trex2 expression in cells expressing the wild-type (WT) Cas9 nuclease and either gRNA 8 or gRNA 15. GC: gene conversion.
Figure 3:
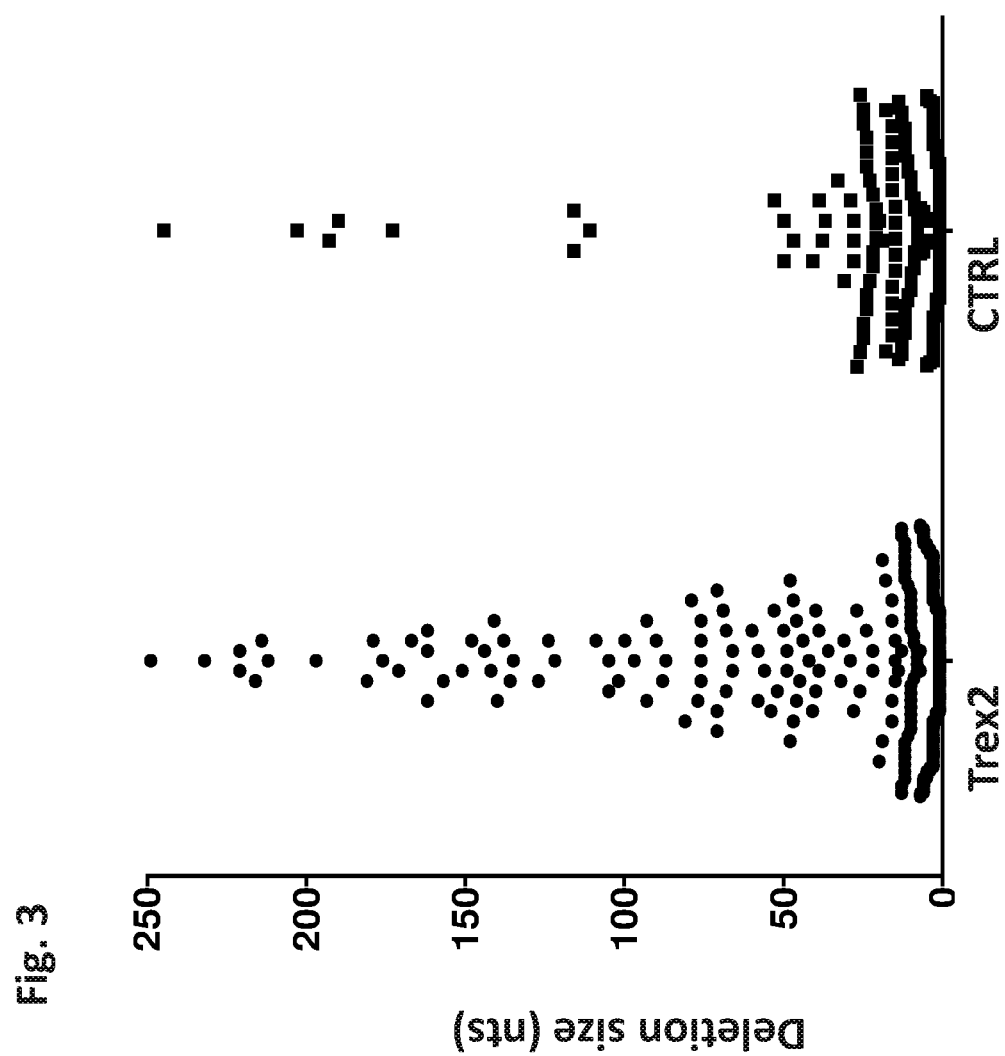
FIG. 3 depicts a dot plot of the deletion size (nucleotides) in the presence (Trex2) or absence (CTRL) of ectopic Trex2 expression as determined by Sanger sequencing. Each dot represents one sequenced deletion.
Figure 4:
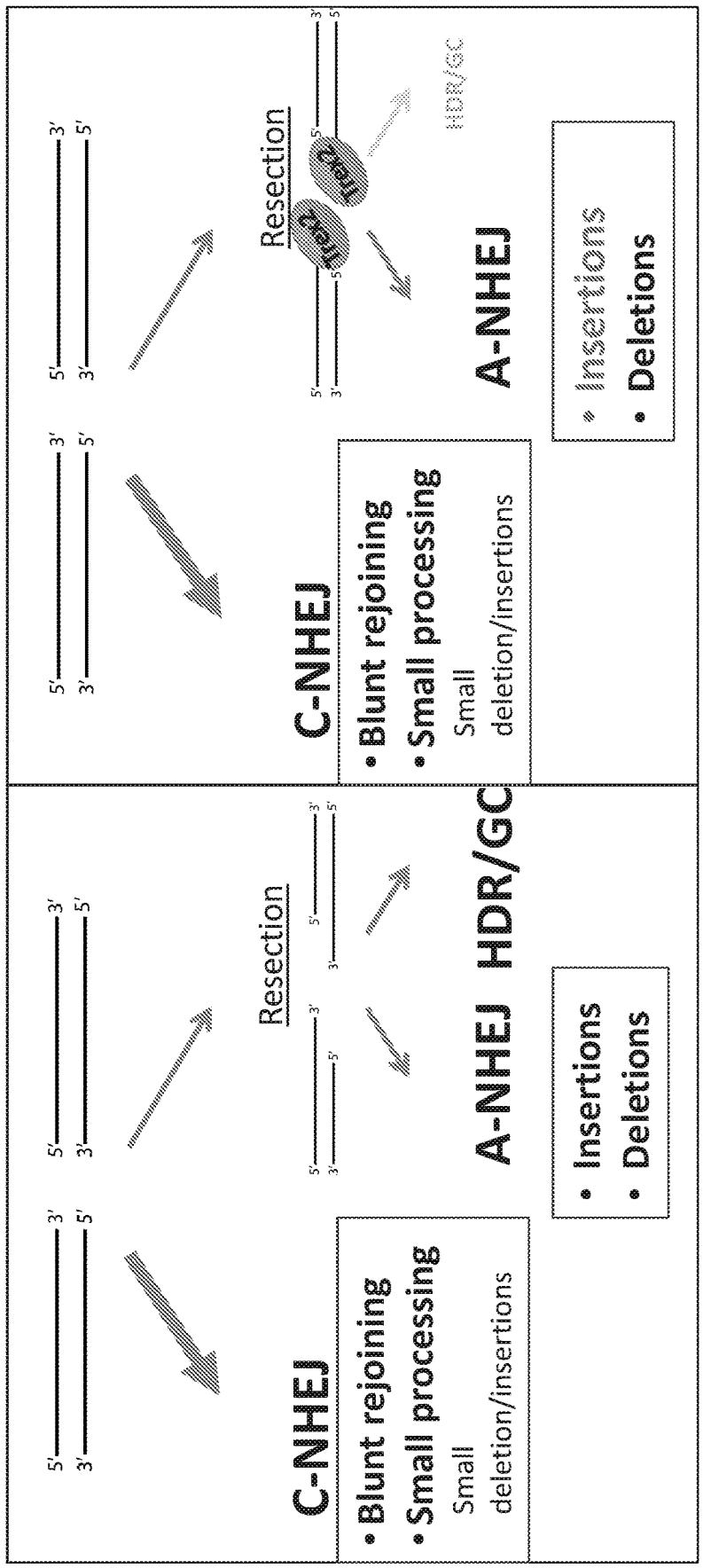
FIG. 4 depicts a model of DNA end processing of wild-type (WT) Cas9-induced double stranded breaks (DSBs) in the presence or absence of ectopic Trex2. In the absence of ectopic Trex2 expression (left box) double-strand break processing is repaired by either C-NHEJ, or through resection-dependent ALT-NHEJ and HDR/gene conversion pathways. Ectopic Trex2 expression (right box), induces a decrease in HDR/gene conversion (GC) frequency and in the occurrence of NHEJ-dependent deletions.

In this setting, a wild type Cas9 induced lesion leads to the formation of a blunt double-strand break. Cells were collected 3 days after electroporation and genomic DNA was extracted. PCR amplification of the HBB locus was performed, followed by subcloning of the PCR product into a Topo Blunt vector. For each condition in each experiment at least 96 colonies were sequenced with Sanger sequencing. As shown in FIG. 2, the majority of the total gene editing events mediated by wild type Cas9 induced double-strand breaks in the absence of ectopic Trex2 were deletions. This is consistent with the notion that blunt ends induced by wild type Cas9 are preferentially repaired by canonical NHEJ. The remaining editing events are gene conversions from the HBD locus, and insertions. However, upon ectopic expression of Trex2 (FIG. 2, +Trex2 panel), there was an increase in the overall modification frequency, and an increase in the occurrence of deletions at the expense of insertions and gene conversion. Moreover, upon ectopic Trex2 expression, a significant shift in the distribution of deletion sizes towards larger deletions was detected (FIG. 3). FIG. 4 provides a model showing the processing of a wild-type Cas9 induced double-strand break in the presence or absence of ectopic Trex2 expression. The absence of ectopic Trex2 expression results in double-strand break processing by either Canonical-NHEJ, or through the resection-dependent ALT-NHEJ and HDR/gene conversion pathways. Upon ectopic Trex2 expression, an increase in the occurrence of NHEJ-dependent deletions was observed.

Figure 5:
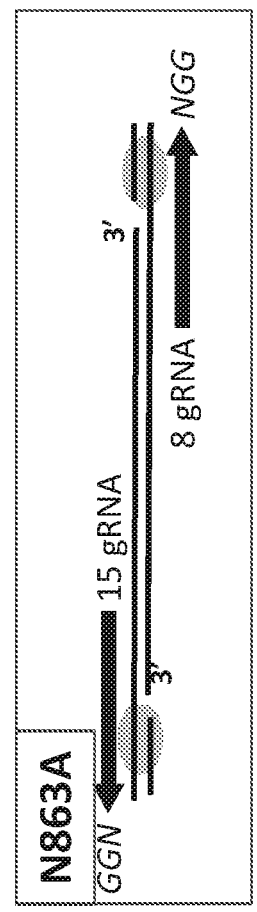
FIG. 5 depicts a schematic of the 8/15 gRNA pair at the HBB locus in combination with the N863A Cas9 nickase.
Figure 6B:
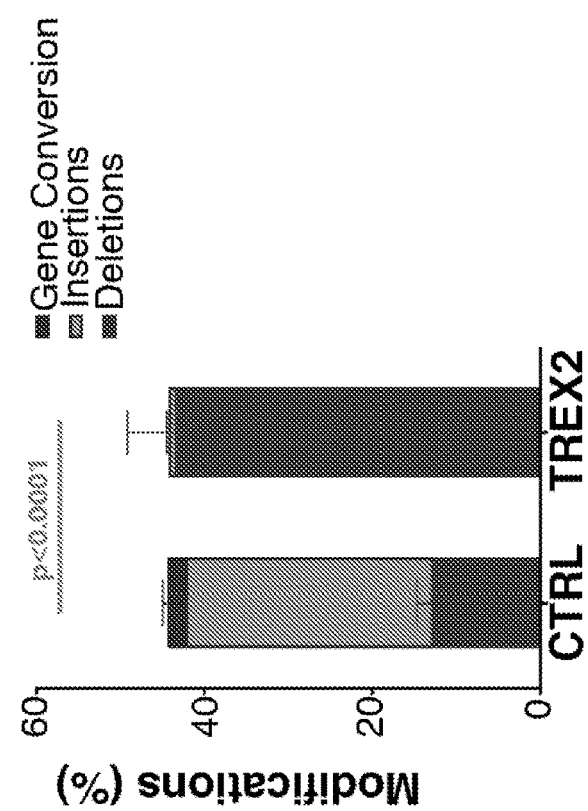
FIGS. 6A and 6B depict the frequency of gene editing outcomes (i.e., insertions, deletions, and gene conversion (GC)) observed in the presence (Trex2) or absence (CTRL) of ectopic Trex2 expression with the N863A nickase and gRNAs 8 and 15. The p-value for the difference in insertion frequency was calculated using the two-tailed Student's t-test (FIG. 6B). 6 independent experiments.
Figure 6A:
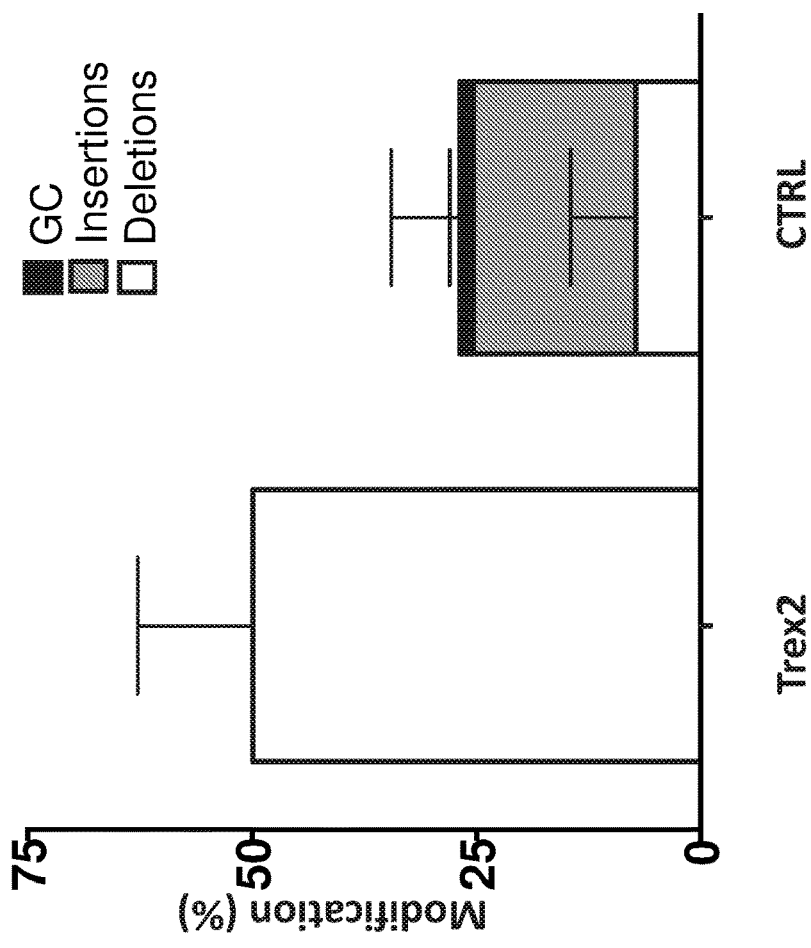
Figure 7B:
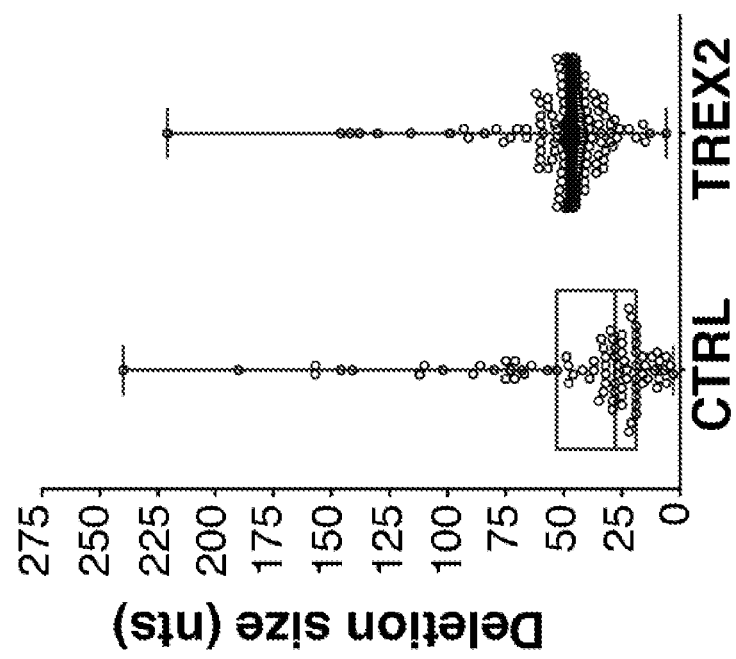
FIGS. 7A and 7B are dot plots depicting the deletion size in the presence (Trex2) or absence (CTRL) of ectopic Trex2 expression as determined by Sanger sequencing. Each dot represents one sequenced deletion.
Figure 7A:
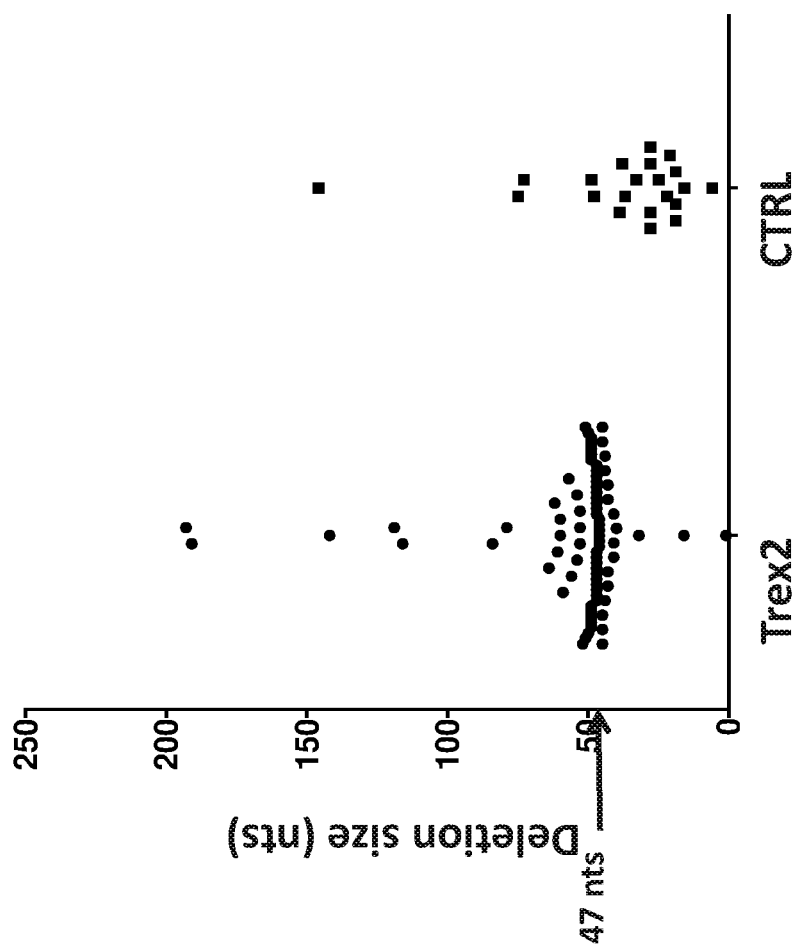
Figures 8A, 8B:
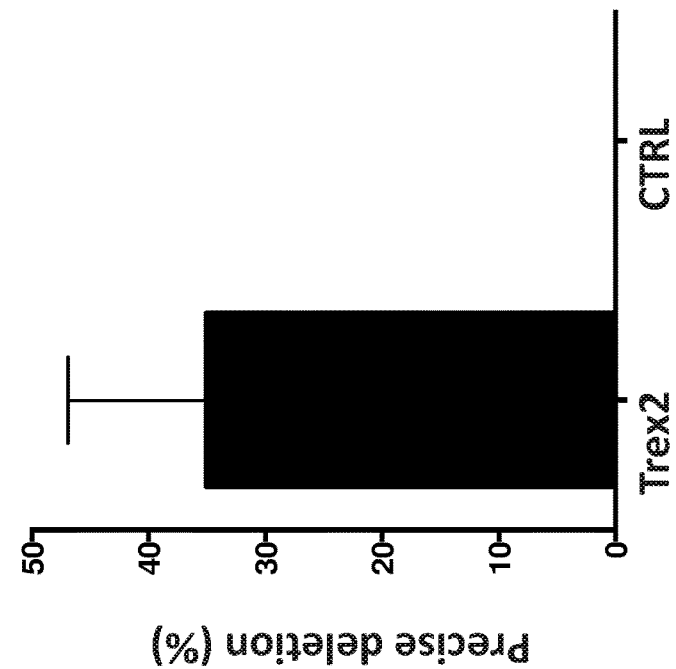
FIG. 8A is a bar graph depicting the percent of all deletions that contain a precise deletion of the 47 nucleotide overhang in the presence (Trex2) or absence (CTRL) of ectopic Trex2 expression.
FIG. 8B is a table showing the percentage of deletions that have the precise overhang deleted and the percentage of deletions that fall within a range of +/−5 nts for N863A nickase-induced lesions with gRNA pairs 8/15, 8/19, or 8/21 in the presence or absence of ectopic Trex2 expression.

Next, the effect of ectopic Trex2 expression in the context of N863A Cas9 nickase-induced DNA lesions was examined. The N863A Cas9 nickase in combination with gRNAs 8 and 15 would leave a 3' overhang of 47 nucleotides (FIG. 5). U2OS cells were electroporated with 750 ng of a plasmid encoding N863A Cas9, 200 ng of plasmid encoding gRNAs 8 and 15, and with or without 500 ng of a plasmid encoding Trex2, followed by gDNA extraction, Topo Blunt cloning and Sanger sequencing of at least 96 individual bacterial colonies. As shown in FIGS. 6A and 6B, in the absence of ectopic Trex2 expression, predominantly insertions were observed, followed by deletions and gene conversion events. Upon ectopic expression of the 3'-5' exonuclease Trex2 (FIGS. 6A and 6B, Trex2 panel), an increase in the overall modification frequency, and an increase in the occurrence of deletions with a significant decrease of insertion and gene conversion frequencies were observed. Upon further analysis of the individual deletions, in cells expressing ectopic Trex2, a predominant deletion size around 47 nts was observed (FIGS. 7A and 7B). This deletion size coincides with the predicted overhang length if the two opposing DNA nicks induced by the N863A Cas9 nickase are converted into double-strand breaks. Indeed, more than 59% of all deletion events were between 45-50 nts in length, and more than 30% of all deletion events were precisely 47 nts when ectopic Trex2 was expressed, which is the predicted overhang length (FIG. 8B). In contrast, no precise 47 nt deletions were detected in the absence of ectopic Trex2 expression and only 4.6% of all deletions were within the 45-50 nts range (FIGS. 8A and 8B).

Figure 9A:
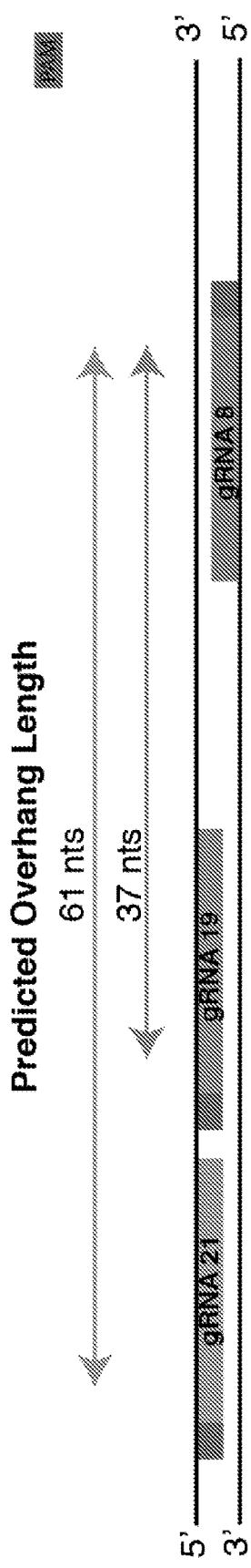
FIG. 9A is a schematic depicting the position of gRNAs 8, 19, and 21 on the HBB locus, alongside the length of the predicted overhang produced using a dual nickase cleavage strategy.
Figure 9C:
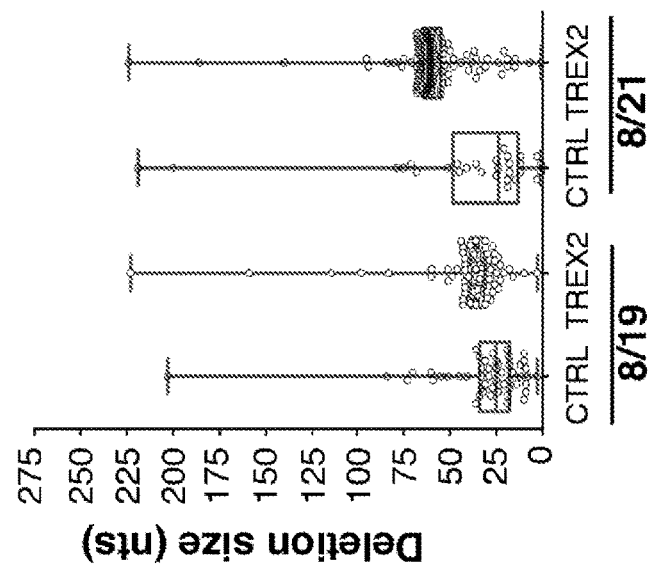
FIG. 9C is a scatter dot plot overlaid with a box and whisker plot representing the deletions size scored from Sanger sequencing data of U2OS cells expressing the N863A-Cas9 nickase with gRNA pair 8/19 or gRNA pair 8/21 in the presence (TREX2) or absence (CTRL) of ectopic Trex2 expression. Each individual dot represents on Sanger sequenced read harboring a deletion.
Figure 9B:
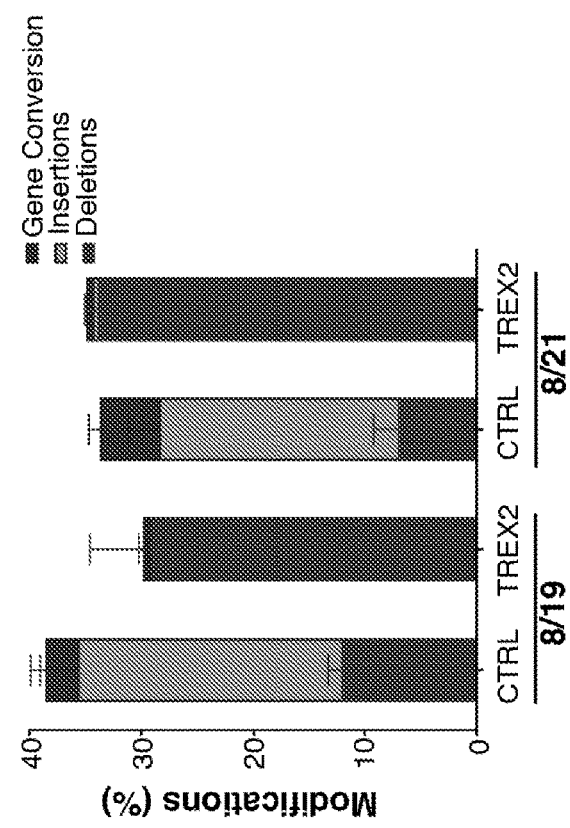
FIG. 9B depicts the overall modification frequency resolved for deletions, insertions, and gene conversion scored by Sanger sequencing of the amplified HBB locus in U2OS cells expressing the N863A-Cas9 nickase and gRNA pairs 8/19 or 8/21 in the presence (TREX2) or absence (CTRL) of ectopic Trex2 expression.

In addition, gRNA pairs 8/19 and 8/21 which are predicted to create overhang lengths of 37 nts or 61 nts, respectively, were tested (FIG. 9A). "gRNA 8" has the targeting domain sequence GUAACGGCAGACUUCUC-CUC (SEQ ID NO: 251), "gRNA 19" has the targeting domain sequence CCUGUGGGGCAAGGUGAACG (SEQ ID NO: 253), "gRNA 21" has the targeting domain sequence UGAAGUUGGUGGUGAGGCCC (SEQ ID NO: 254). As shown in FIG. 9B, the modification distribution balance shifted almost exclusively towards deletions upon ectopic Trex2 expression. Similarly, upon ectopic Trex2 expression 12.1% of all deletions mapped precisely to the predicted 37 nt overhang when the gRNA pair 8/19 was used and 23.2% of all deletions to the predicted 61 nts overhang when the gRNA pair 8/21 was used, while no precise deletions were observed in cells not expressing ectopic Trex2 (FIGS. 9C and 8B).

These results are summarized in a model in FIG. 10. In the absence of ectopic Trex2, the 3' protruding arm is predominantly processed by NHEJ, leading to the frequent occurrence of insertions, followed by deletions and HDR/GC events. Upon ectopic Trex2 expression, a significant increase in NHEJ-mediated deletions is observed, while both HDR/GC and insertions are strongly suppressed.

Figure 11:
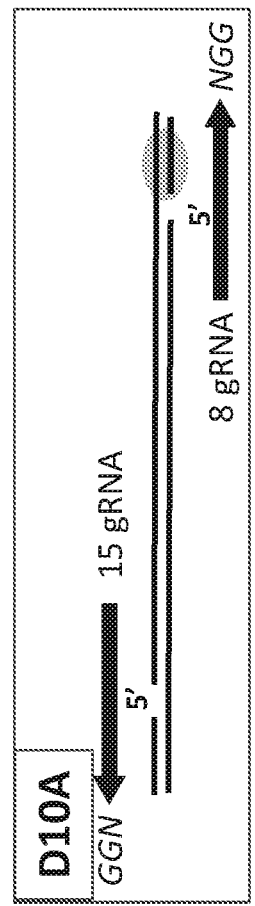
FIG. 11 is a schematic depicting gRNA pair 8/15 at the HBB locus in combination with the D10A Cas9 nickase.
Figure 12B:
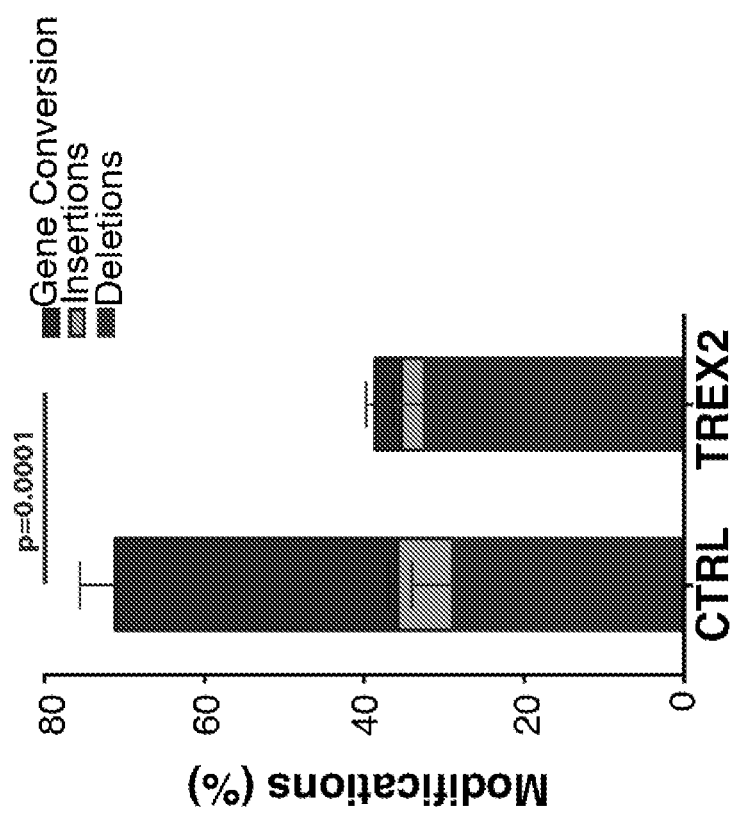
FIGS. 12A and 12B depict the types of gene editing outcomes observed in the presence (Trex2) or absence (CTRL) of ectopic Trex2 expression with the D10A Cas9 nickase-induced lesions using gRNA pair 8/15. The p-value (FIG. 13B) for the difference in gene conversion frequency was calculated using the two-tailed Student's t-test. 3 independent experiments.
Figure 12A:
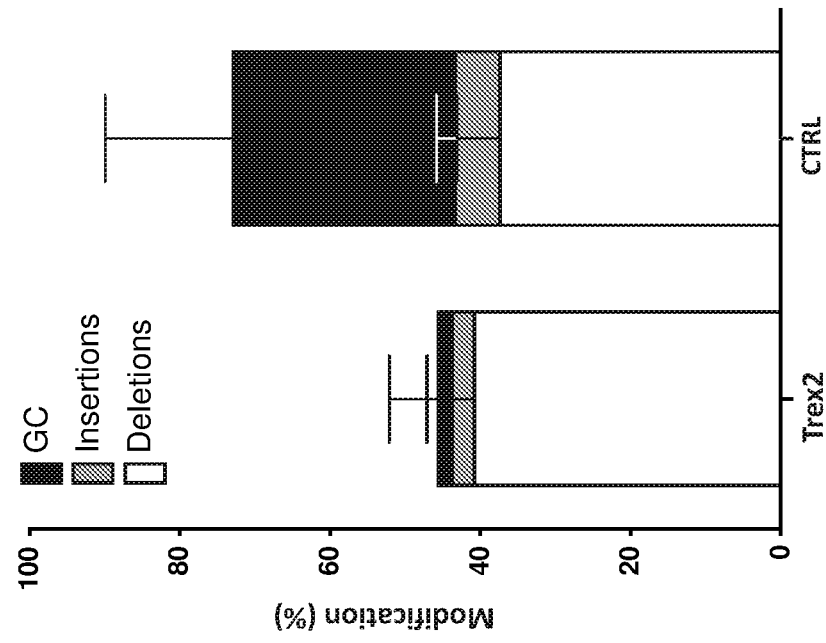
Figure 14B:
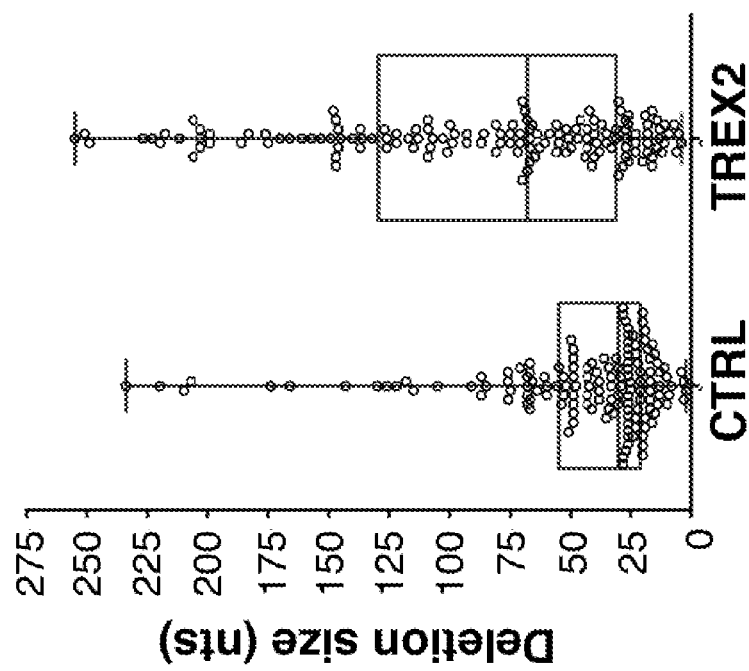
FIGS. 14A and 14B depict dot plots of the deletion size in the presence (Trex2) or absence (CTRL) of ectopic Trex2 expression as determined by Sanger sequencing. Each dot represents one sequenced deletion.
Figure 14A:
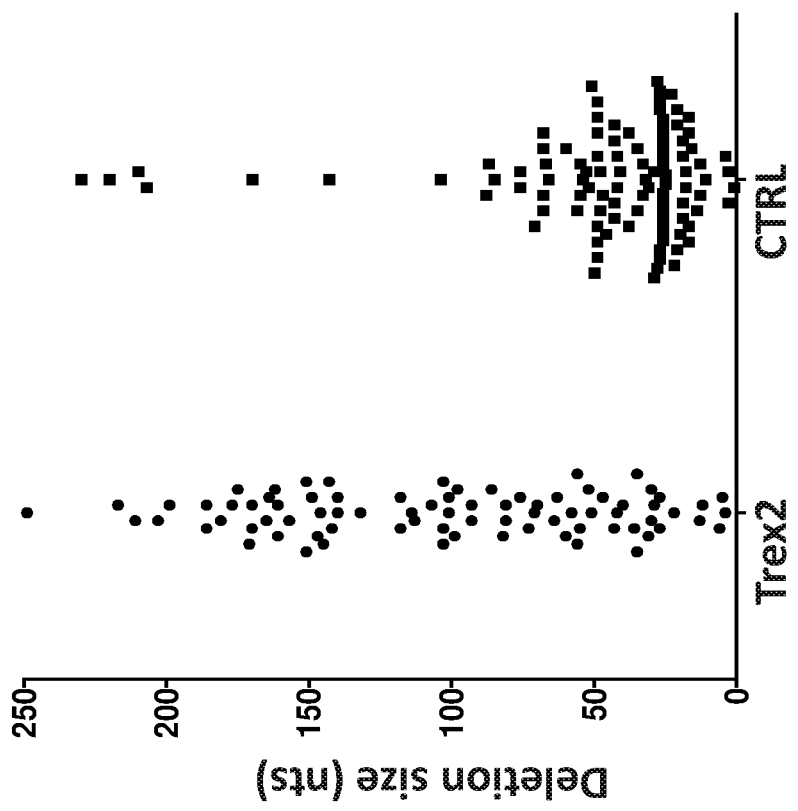

Lastly, the effect of ectopic Trex2 expression on the modification profile of DNA lesions induced by the D10A Cas9 nickase was analyzed. As shown in FIG. 11, the D10A Cas9 nickase in combination with gRNAs 8 and 15 creates a 5' overhang of 47 nts. U2OS cells were electroporated with 750 ng of plasmid encoding D10A Cas9, 200 ng of a plasmid encoding gRNAs 8 and 15, and with or without 500 ng of a plasmid encoding Trex2, followed by gDNA extraction, Topo Blunt cloning and Sanger sequencing of at least 96 individual bacterial colonies. As shown in FIGS. 12A and 12B, in the absence of ectopic Trex2 expression, predominantly deletions and gene conversion events were observed, followed by insertions. Upon expression of ectopic Trex2 (FIGS. 12A and 12B, Trex2 panel), while the overall deletion frequency remained constant, a significant decrease in gene conversion frequency was observed, indicating that a 3' overhang is produced when D10A Cas9-induced lesions are processed during gene conversion. This result was confirmed using gRNA pairs 8/19 and 8/21, which are predicted to produce overhang lengths of either 37 nts or 61 nts, respectively (FIG. 13A). In agreement with the result from gRNA pair 8/15, gene conversion was almost completely abrogated upon ectopic Trex2 expression (FIG. 13B), indicating that a 3' ssDNA intermediate is required. Moreover, the deletions observed upon processing of D10A Cas9-induced lesions using gRNA pair 8/15, in the presence of ectopic Trex2 expression, were larger than the deletions in the absence of ectopic Trex2 expression (FIGS. 14A and 14B). Similar increases in deletion size were observed with gRNA pairs 8/19 and 8/21 (FIG. 14C).

Figure 15:
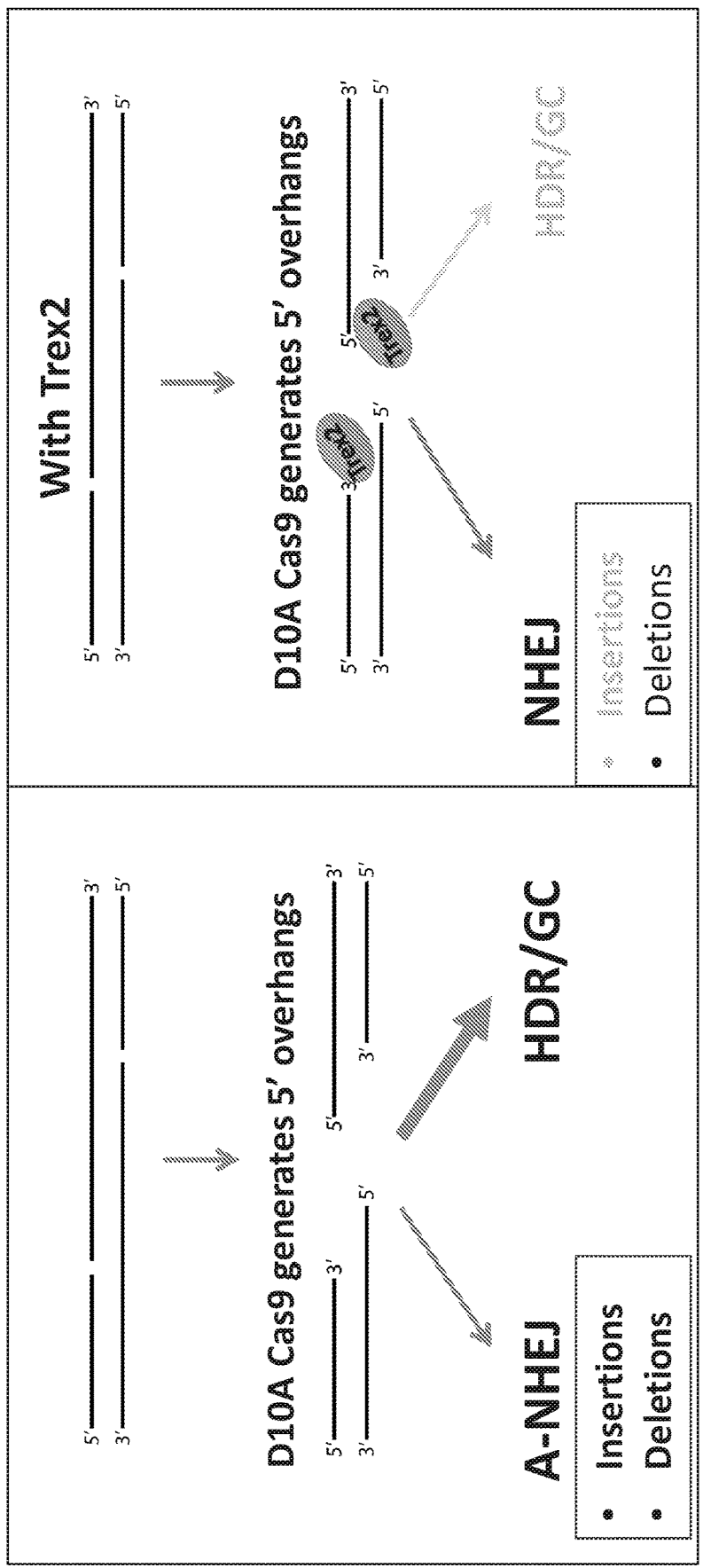
FIG. 15 depicts a model of DNA end processing at D10A Cas9-induced double stranded breaks (DSBs) with or without ectopic Trex2 expression. In the absence of ectopic Trex2 expression (left box), processing of the 5' protruding arm leading to predominantly HDR/GC and deletions was observed. Upon ectopic Trex2 expression (right box), a significant decrease of HDR/GC and NHEJ-mediated insertions was observed.

These results are summarized in a model in FIG. 15. In the absence of ectopic Trex2 expression, processing of the 5' protruding arm leading to predominantly deletions and HDR/GC. Upon ectopic Trex2 expression, a striking decrease of the HDR/GC frequency is observed, as well as a decrease of NHEJ-mediated insertions.

In summary, these data suggest that expression of different Cas9 variants leads to different DNA end structures, which engage different repair pathways, leading to different DNA repair outcomes. Using the 3'-5' exonuclease Trex2 as an example, the ectopic expression of a DNA end-processing enzyme acting on these DNA ends has been shown to modulate DNA repair outcomes.

Figure 16A:
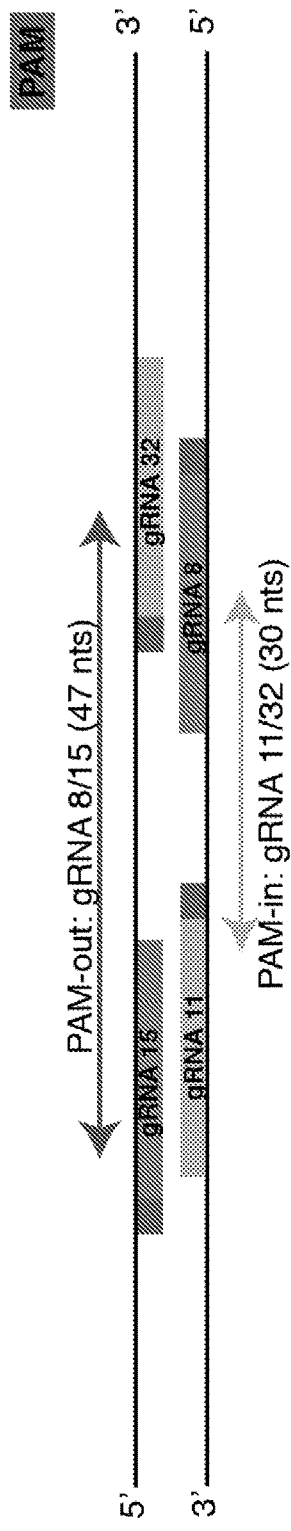
FIG. 16A is schematic depicting the position of gRNAs 8, 15, 11, and 32 on the HBB locus, alongside the length of the predicted overhang produced using a dual nickase cleavage strategy, as well as the PAM orientation (red).
Figure 16C:
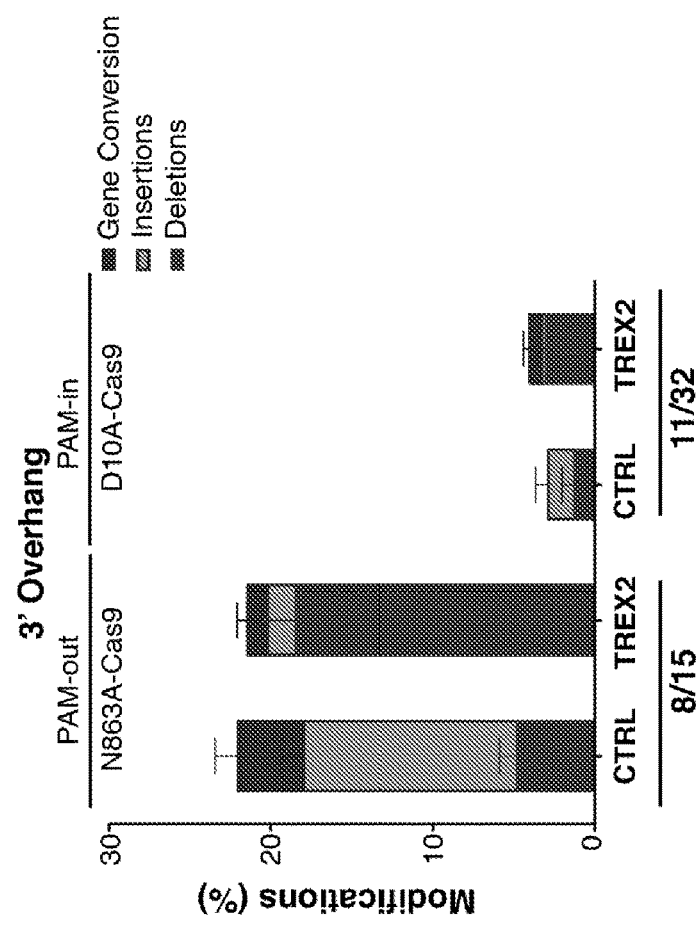
FIG. 16C depicts the overall modification frequency resolved for deletions, insertions, and gene conversion scored by Sanger sequencing of the amplified HBB locus in U2OS cells expressing the N863A-Cas9 nickase and gRNA pair 8/15 (PAM-out) or the D10A-Cas9 nickase and gRNA pair 11/32 (PAM-in) in the presence (TREX2) or absence (CTRL) of ectopic 3'-5' exonuclease Trex2 expression.
Figure 16B:
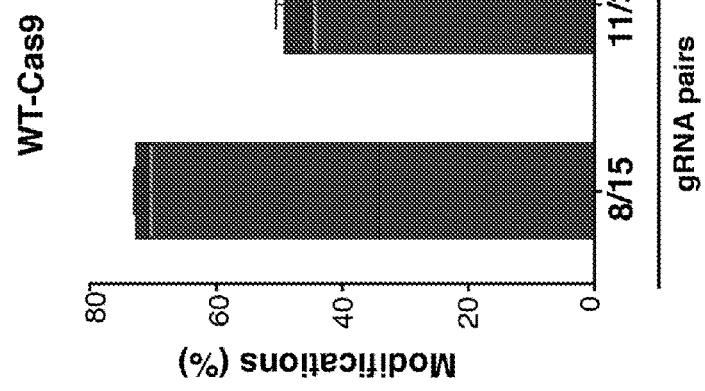
FIG. 16B depicts the overall modification frequency resolved for deletions, insertions, and gene conversion scored by Sanger sequencing of the amplified HBB locus in U2OS cells expressing the WT-Cas9 variant and gRNA pairs 8/15 (PAM-out) or 11/32 (PAM-in). 4 independent experiments.
Figures 17A, 17B:
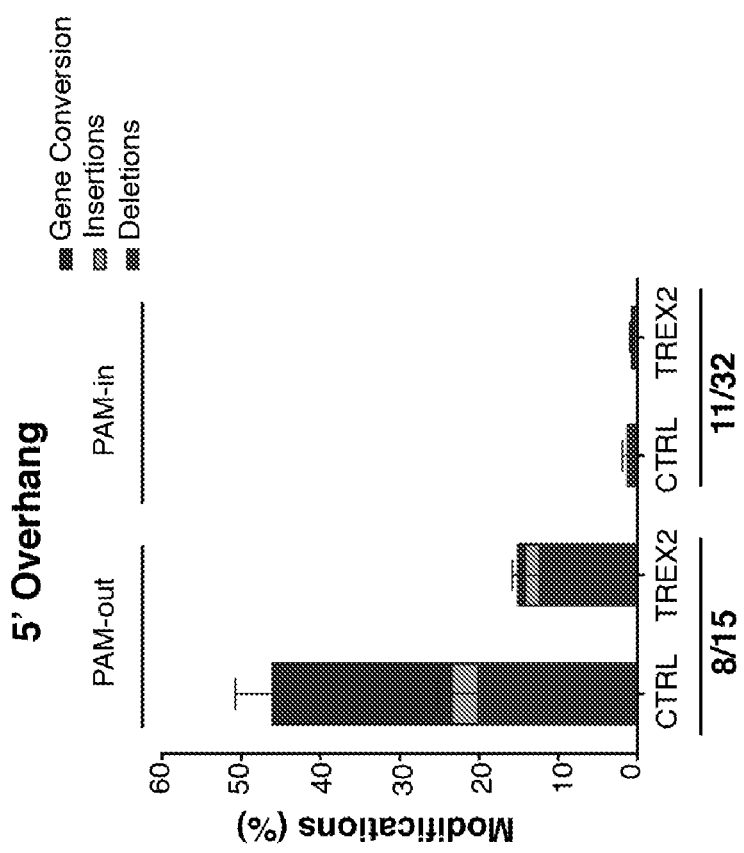
FIG. 17A is a table showing the frequency of deletions that harbor a precise deletion of the predicted overhang scored by Sanger sequencing of the amplified HBB locus in U2OS cells expressing WT Cas9 and gRNA pairs 8/15 (PAM-out) or 11/32 (PAM-in). 4 independent experiments.
FIG. 17B depicts the overall modification frequency resolved for deletions, insertions, and gene conversion scored by Sanger sequencing of the amplified HBB locus in U2OS cells expressing the D10A-Cas9 nickase and gRNA pair 8/15 (PAM-out) or the N863A-Cas9 variant and gRNA pair 11/32 (PAM-in) with (TREX2) or without (CTRL) ectopic 3'-5' exonuclease Trex2 expression.

Example 2: Overhang Structure Intermediates are not Observed when Using gRNAs with PAM-In Configuration All of the above experiments were performed with gRNAs, in which PAMs face outwards with respect to each other. Theoretically, 3' and 5' overhang structures would also be possible to achieve with gRNAs which point the PAMs in an inwards orientation with respect to each other. To address whether Cas9-induced lesions generated using gRNAs with a PAM-in orientation produce similar end structures as in the PAM-out orientation, the gRNA pair 11 and 32 was selected for use on the HBB locus (FIG. 16A). "gRNA 11" has the targeting domain sequence CACGUUCACCUUGCCCCACA (SEQ ID NO: 255), and "gRNA 32" has the targeting domain sequence CAUGGUGCAUCUGACUCCUG (SEQ ID NO: 256), First, experiments were performed to test whether simultaneous cutting can occur with gRNA pair 11 and 32 by expressing both of these gRNAs with WT-Cas9 in U2OS cells. Using the PAM-in facing gRNA pair 11 and 32 with the D10A-Cas9 variant would be predicted to yield a 30 nts 3' overhang. As shown in FIGS. 16B and 17A, the predominant repair event was a precise deletion of the predicted 30 nts, indicating that indeed simultaneous cutting can occur with similar efficiency as in control PAM-out configurations from gRNAs 8/15. While the 3' overhang generated with PAM-out gRNAs 8/15 in combination with Cas9-N863A nickase resulted in the expected strand separation and DSB formation, the PAM-in facing gRNA pair 11/32, when used with D10A-Cas9 nickase, did not result in a comparable degree of insertions or other locus disruption events (FIG. 16C). If a 3' overhang was generated in a PAM-in configuration with the D10A-Cas9 nickase, said 3' overhang is expected to be sensitive to 3'-5' exonuclease Trex2 ectopic expression. While the control 3' overhang generated with PAM-out facing gRNAs 8/15 with N863A results in precise deletions of the predicted overhang structure, no precise deletions were observed with the PAM-in facing 3' overhang generating gRNA pair 11 and 32 (FIG. 16C) when used in combination with the D10A Cas9 nickase, suggesting that a 3' overhang is not formed. Similarly, the gRNA pair 11 and 32 does not lead to locus disruption events when used with N863A-Cas9 nickase, which would be expected to yield a 5' overhang structure (FIG. 17B). In summary, these data suggest that strand separation can occur efficiently with gRNAs in the PAM-out orientation, but that no overhangs are formed with gRNAs in the PAM-in orientation separated by comparable distances.

Figure 18A:
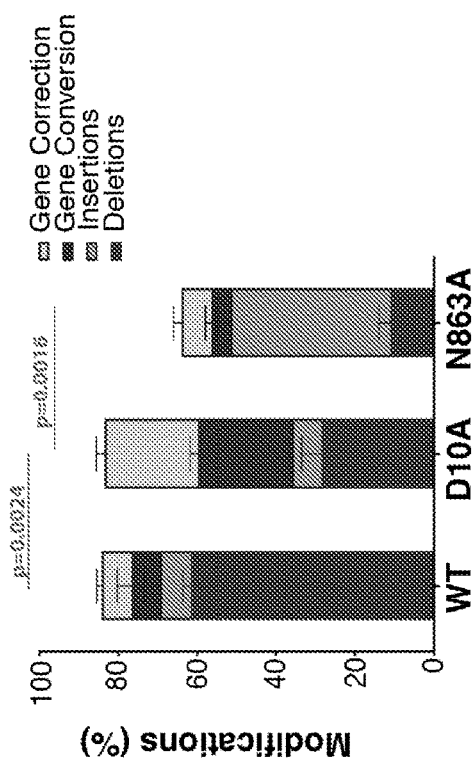
FIG. 18A depicts the overall modification frequency at the HBB locus resolved for deletions, insertions, gene conversion, and gene correction. The different repair outcomes after WT Cas9, D10A-Cas9 nickase, or N863A-Cas9 nickase-induced lesions in the presence of ssODN donor template in U2OS cells was measured by PCR amplification of the HBB locus, followed by Sanger sequencing of individual amplification products. The p-value for the difference in gene correction frequency was calculated using the two-tailed Student's t-test. At least 3 independent experiments were performed per condition.

Example 3: The D10A-Cas9 Nickase-Induced Dual Nicking Strategy Generates a 5' Overhang and Increased Gene Correction Efficiency was Observed To correct a specific genetic mutation, single-stranded oligodeoxynucleotides (ssODNs) harboring the corrective sequence are frequently used. Since different repair outcomes were observed using the different Cas9 variants, gene correction efficiencies were assessed using different Cas9/gRNA variant combinations in the presence of a 179 nt ssODN donor template (FIG. 18A). As shown in FIG. 18A, similarly to gene conversion, the D10A-Cas9 nickase, which creates a 5' overhang upon cleavage yielded the highest gene correction rates (23.8% for D10A-Cas9 compared to 7.7% for WT-Cas9 ($p=0.0024$) and 7.5% for N863A-Cas9 ($p=0.0016$)).

Figure 18C:
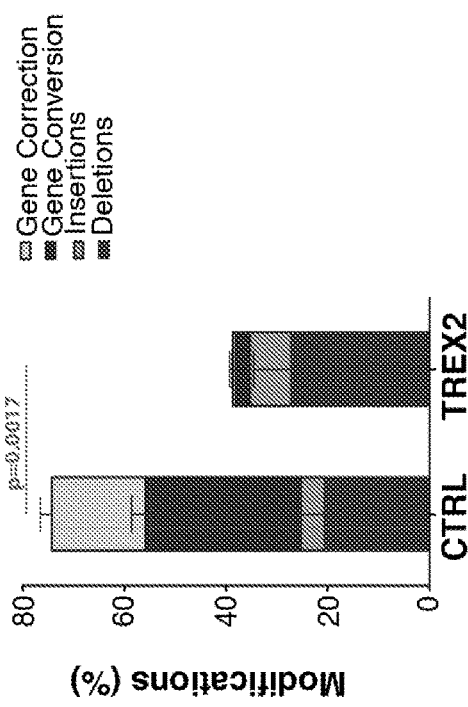
FIG. 18C depicts the overall modification frequency in U2OS cells resolved for deletions, insertions, gene conversion, and gene correction of D10A Cas9 nickase-induced lesions using gRNA pair 8/15 in the presence of ssODN donor template, and either in the presence (TREX2) or absence (CTRL) of ectopic Trex2 expression. Modification frequency was scored by Sanger sequencing of the amplified HBB locus. The p-value for the difference in gene correction frequency was calculated using the two-tailed Student's t-test. At least 3 independent experiments per condition.
Figure 18B:
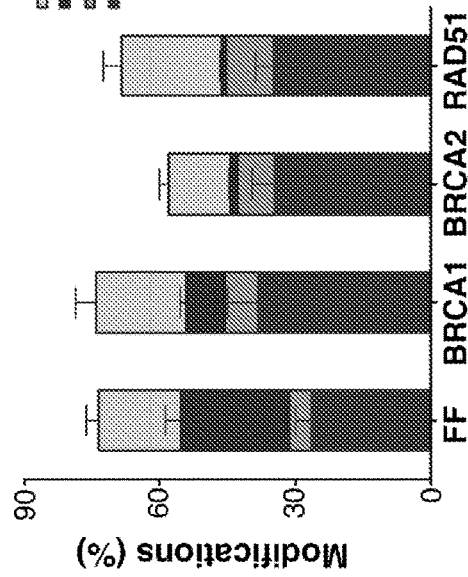
FIG. 18B depicts the characterization of the genetic requirements of gene correction. U2OS cells were nucleofected with siRNAs against either firefly luciferase (FF; control), BRCA1, BRCA2, or RAD51 to knockdown the expression of said genes, and gene editing events at the HBB locus resulting from WT Cas9-, D10A Cas9 nickase-, and N863A-Cas9 nickase-induced lesions using gRNA pair 8/15 assessed in the presence of ssODN donor template. The overall modification frequency at the HBB locus resolved for deletions, insertions, gene conversion and gene correction was determined by Sanger sequencing. 4 independent experiments.
Figure 19A:
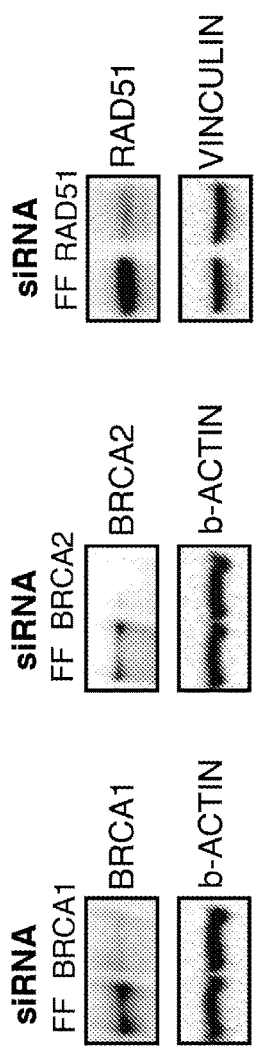
FIG. 19A depicts Western Blots showing the knockdown efficiency after treatment of U2OS cells with siRNAs against firefly luciferase (FF), BRCA1, BRCA2, or RAD51. The loading control for BRCA1 and BRCA2 was 3-ACTIN, and for RAD51 the loading control was vinculin.

To dissect the genetic requirements of gene correction in the presence of an exogenous ssODN donor template, siRNAs were used to knock down the expression of HR components BRCA1, BRCA2, and RAD51 (FIG. 19A). As shown in FIG. 18B, gene correction with an ssODN proceeds through a pathway that is independent of the BRCA1, BRCA2, and RAD51.

Figure 19B:
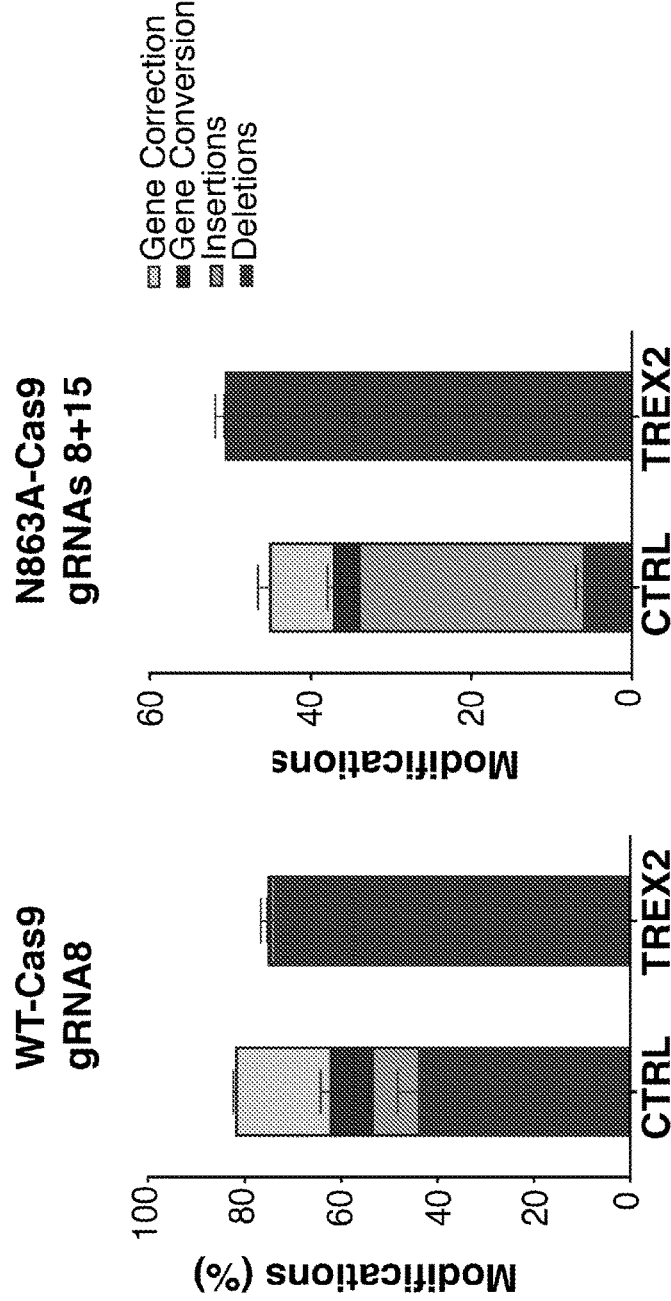
FIG. 19B depicts the overall modification frequency resolved for deletions, insertions, gene conversion, and gene correction scored by Sanger sequencing of WT Cas9-induced or N863A Cas9-induced lesions of the HBB locus in U2OS cells using gRNA pair 8/15 in the presence (TREX2) or absence (CTRL) of ectopic Trex2 expression.

To determine whether a 3' ssDNA intermediate is required for gene correction using an exogenous ssODN donor template, the 3'-5' exonuclease Trex2 was expressed in cells. As demonstrated in FIG. 18C, gene correction is also strictly dependent on the presence of a 3' ssDNA intermediate. While the frequency of gene correction was lower for WT and N863A-Cas9 nickase-induced lesions than for D10A-Cas9 nickase-induced lesions, complete abrogation of gene correction in the presence of ectopic Trex2 expression was observed, indicating that a 3' intermediate is required for successful gene correction under these conditions (FIG. 19B).

Example 4: Gene Conversion Efficiency is Highest in D10A Dual Nicking Approach Generating a 5' Overhang Gene conversion is thought to be a highly precise mechanism that repairs DSBs during the S/G2 phases of the cell cycle through the HR pathway. The genetic requirements of HR are well characterized: initially, 3-5' end resection leads to the exposure of a single stranded 3' overhang. Subsequently, BRCA2-dependent RAD51 loading onto the ssDNA overhang initiates homology search and strand invasion.

Figure 20A:
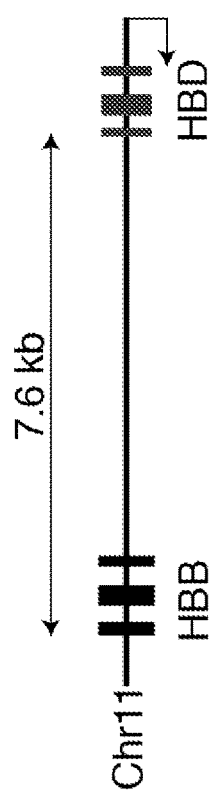
FIG. 20A is a schematic depicting HBB and HBD locus organization on human chromosome 11.

The rate of gene conversion of the HBB gene from the highly homologous HBD gene was examined. The HBD gene lies about 7.6 kb upstream of the HBB gene on chromosome 11 (FIG. 20A), and bears >90% sequence homology with respect to the HBB gene.

Figure 20B:
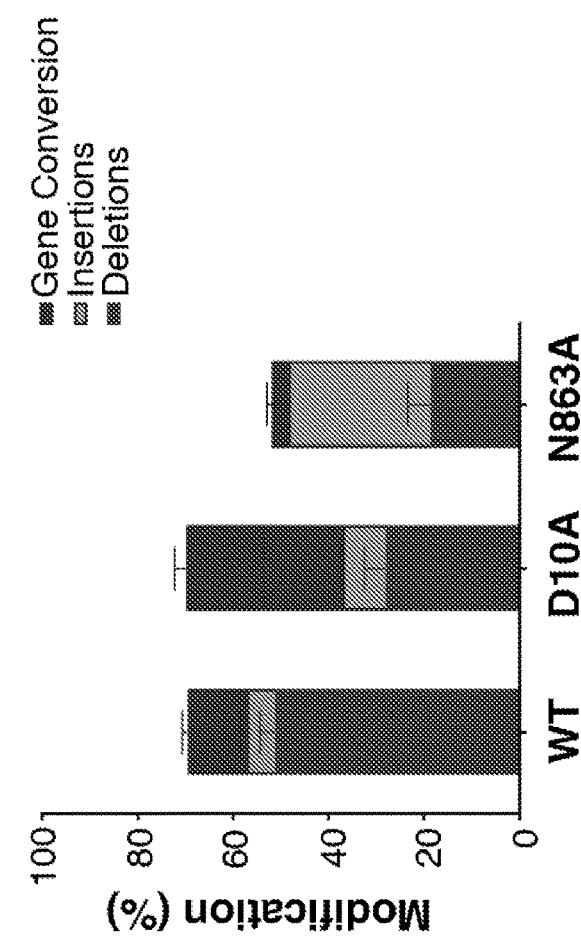
FIG. 20B depicts the overall modification frequency at the HBB locus resolved for deletions, insertions, and gene conversion. The different repair outcomes after WT Cas9-, D10A-Cas9 nickase-, or N863A-Cas9 nickase-induced lesions in U2OS cells was measured by PCR amplification of the HBB locus, followed by Sanger sequencing of individual amplification products. 5 independent experiments.

When comparing the rate of gene conversion from the HBD gene between WT-Cas9-induced lesions and D10A Cas9 nickase-, or N863A-Cas9 nickase-induced lesions, D10A Cas9 nickase-induced lesions showed a significantly increased rate of gene conversion (GC) from the HBD gene (32.8% in D10A versus 12.4% in WT; $p=0.0001$), while N863A-Cas9 nickase-induced lesions showed a significant reduction in GC relative to WT Cas9-induced lesions (3.5% for N863A Cas9-induced lesions vs. 12.4% for WT Cas9-induced lesions; $p=0.0016$) (FIG. 20B), suggesting that the DNA structure resulting from a D10A-Cas9 nickase-induced DNA lesion is particularly amendable for GC from the endogenous HBD gene.

The finding that a 5' overhang was more efficient in mediating GC than a N863A-Cas9 nickase-induced 3' overhang was surprising, as HR typically proceeds through an exposed 3' ssDNA intermediate. To determine whether a 3' ssDNA intermediate is required for gene conversion, the 3'-5' exonuclease Trex2 was expressed in cells. As demonstrated in FIGS. 12A and 12B, upon Trex2 expression, a strong reduction in GC frequency was observed, indicating that gene conversion mediated by D10A-Cas9 nickase induced lesions is strictly dependent on the presence of a 3' ssDNA intermediate.

Figure 21:
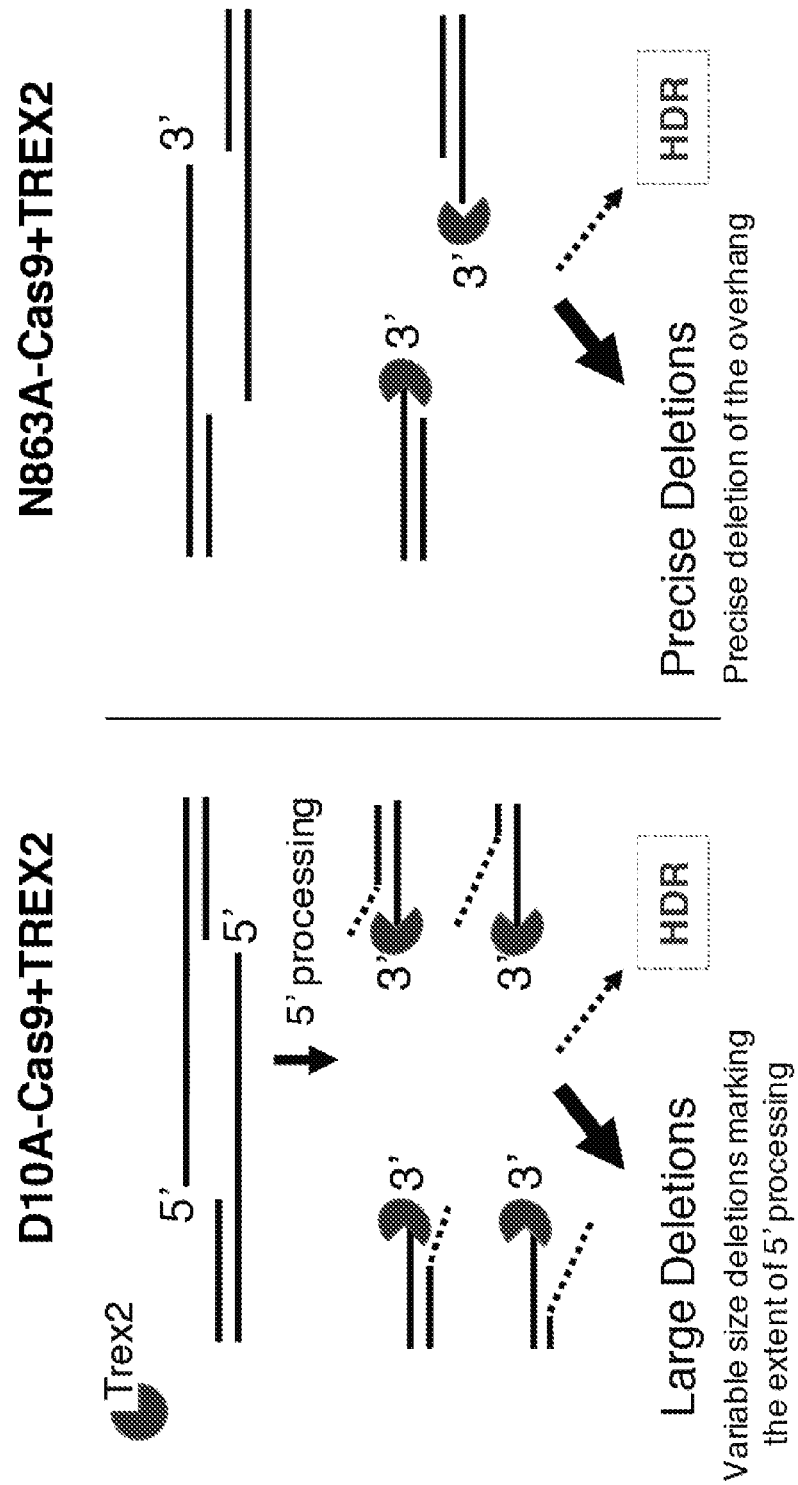
FIG. 21 is a schematic depicting the model for producing large deletions using the D10A Cas9 molecule in combination with Trex2 and the model for producing precise deletions with the N863A Cas9 molecule in combination with Trex2.

Results from this study have important implications in genome engineering and therapeutic approaches. First, these results establish that choosing the appropriate Cas9 variant can strongly favor a desired repair outcome or repress an undesired outcome. Specifically, a dual nicking approach resulting in a 5' overhang favors HR and ssODN-mediated gene correction. Moreover, the results indicate that not only ectopically administered donors can serve as templates for therapeutically relevant gene correction, but also that endogenous donors such as the HBD gene can provide a proper template for DNA lesion repair. The general concept of using pseudogenes or arrays of highly homologous genes could be harnessed for therapeutic indications if such genes do not harbor the disease causing mutation. Lastly, the ectopic Trex2 overexpression data indicate that the repair balance can be shifted towards a desired outcome such as precise deletions (see FIG. 21).

Example 5: Cas9 Ribonucleoprotein Complex Delivery to Target Cells Expressing Ectopic Trex2 Modulates DNA Repair Outcomes To determine whether the delivery of Cas9 ribonucleoprotein complexes and a plasmid encoding Trex2 could be used to modulate DNA repair outcomes of Cas9-induced lesions, as was observed in cells nucleofected with plasmids encoding Trex2, Cas9 and gRNA, U2OS cells were nucleofected with pre-formed ribonucleoprotein complexes formed with 24 pmols of Cas9 and 12 pmols of each of gRNA 8 and gRNA 15, in the presence or absence of nucleofection with a plasmid encoding Trex2. As a control, U2OS cells were nucleofected with 250 ng of a plasmid encoding gRNA 8 and gRNA 15, 750 ng of a plasmid encoding N863A Cas9 nickase, in the presence or absence of nucleofection with 500 ng of a plasmid encoding Trex2. Cells were collected 5 days after nucleofection and genomic DNA was extracted. PCR amplification of the HBB locus was performed, followed by subcloning of the PCR product into a Topo Blunt vector, and sequence analysis performed using an Illumina® MiSeq sequencer. As shown in FIG. 22B, nucleofection with Cas9 ribonucleoprotein complexes in the presence of ectopic Trex2 expression resulted in the formation of precise 47 nucleotide deletions and a decrease in large insertions as compared to the delivery of Cas9 ribonucleoprotein complexes alone. The modulation in repair outcomes observed in cells nucleofected with Cas9 ribnucleoprotein complexes in the presence of ectopic Trex2 expression was similar to the modulation of repair outcomes observed in cells nucleofected with plasmids expressing Trex2, Cas9 and gRNA (see FIG. 22A).

INCORPORATION BY REFERENCE

All publications, patents, and patent applications mentioned herein are hereby incorporated by reference in their entirety as if each individual publication, patent or patent application was specifically and individually indicated to be incorporated by reference. In case of conflict, the present application, including any definitions herein, will control.

EQUIVALENTS

Those skilled in the art will recognize, or be able to ascertain using no more than routine experimentation, many equivalents to the specific embodiments of the invention described herein. Such equivalents are intended to be encompassed by the following claims.

Other embodiments are within the following claims.

SEQUENCE LISTING (339 sequences)

SEQ ID NO: 1 - protein, 1345 aa, Streptococcus mutans
  misc_feature (10)..(21): N-terminal RuvC-like domain
  misc_feature (759)..(766): RuvC-like domain
  misc_feature (837)..(863): HNH-like domain
  misc_feature (982)..(989): RuvC-like domain
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 2 - protein, 1368 aa, Streptococcus pyogenes [sequence omitted]

SEQ ID NO: 3 - DNA, 4107 bp, Streptococcus pyogenes
atggataaaaagtacagcatcgggctggacatcggtacaaactcagtggggtgggccgtgattacggacgagtacaaggtaccctccaaaaaatttaaagtgctgggtaacacggacagacactctataaagaaaaatcttattggagccttgctgttcgactcaggcgagacagccgaagccacaaggttgaagcggaccgccaggaggcggtataccaggagaaagaaccgcatatgctacctgcaagaaatcttcagtaacgagatggcaaaggttgacgatagctttttccatcgcctggaagaatcctttcttgttgaggaagacaagaagcacgaacggcaccccatctttggcaatattgtcgacgaagtggcatatcacgaaaagtacccgactatctaccacctcaggaagaagctggtggactctaccgataaggcggacctcagacttatttatttggcactcgcccacatgattaaatttagaggacatttcttgatcgagggcgacctgaacccggacaacagtgacgtcgataagctgttcatccaacttgtgcagacctacaatcaactgttcgaagaaaaccctataaatgcttcaggagtcgacgctaaagcaatcctgtccgcgcgcctctcaaaatctagaagacttgagaatctgattgctcagttgcccggggaaaagaaaaatggattgtttggcaacctgatcgccctcagtctcggactgaccccaaatttcaaaagtaacttcgacctggccgaagacgctaagctccagctgtccaaggacacatacgatgacgacctcgacaatctgctggcccagattggggatcagtacgccgatctctttttggcagcaaagaacctgtccgacgccatcctgttgagcgatatcttgagagtgaacaccgaaattactaaagcaccccttagcgcatctatgatcaagcggtacgacgagcatcatcaggatctgaccctgctgaaggctcttgtgaggcaacagctccccgaaaaatacaaggaaatcttctttgaccagagcaaaaacggctacgctggctatatagatggtggggccagtcaggaggaattctataaattcatcaagcccattctcgagaaaatggacggcacagaggagttgctggtcaaacttaacagggaggacctgctgcggaagcagcggacctttgacaacgggtctatcccccaccagattcatctgggcgaactgcacgcaatcctgaggaggcaggaggatttttatccttttcttaaagataaccgcgagaaaatagaaaagattcttacattcaggatcccgtactacgtgggacctctcgcccggggcaattcacggtttgcctggatgacaaggaagtcagaggagactattacaccttggaacttcgaagaagtggtggacaagggtgcatctgcccagtctttcatcgagcggatgacaaattttgacaagaacctccctaatgagaaggtgctgcccaaacattctctgctctacgagtactttaccgtctacaatgaactgactaaagtcaagtacgtcaccgagggaatgaggaagccggcattccttagtggagaacagaagaaggcgattgtagacctgttgttcaagaccaacaggaaggtgactgtgaagcaacttaaagaagactactttaagaagatcgaatgttttgacagtgtggaaatttcaggggttgaagaccgcttcaatgcgtcattggggacttaccatgatcttctcaagatcataaaggacaaagacttcctggacaacgaagaaaatgaggatattctcgaagacatcgtcctcaccctgaccctgttcgaagacagggaaatgatagaagagcgcttgaaaacctatgcccacctcttcgacgataaagttatgaagcagctgaagcgcaggagatacacaggatggggaagattgtcaaggaagctgatcaatggaattagggataaacagagtggcaagaccatactggatttcctcaaatctgatggcttcgccaataggaacttcatgcaactgattcacgatgactctcttaccttcaaggaggacattcaaaaggctcaggtgagcgggcagggagactcccttcatgaacacatcgcgaatttggcaggttcccccgctattaaaaagggcatccttcaaactgtcaaggtggtggatgaattggtcaaggtaatgggcagacataagccagaaaatattgtgatcgagatggcccgcgaaaaccagaccacacagaagggccagaaaaatagtagagagcggatgaagaggatcgaggagggcatcaaagagctgggatctcagattctcaaagaacaccccgtagaaaacacacagctgcagaacgaaaaattgtacttgtactatctgcagaacggcagagacatgtacgtcgaccaagaacttgatattaatagactgtccgactatgacgtagaccatatcgtgccccagtccttcctgaaggacgactccattgataacaaagtcttgacaagaagcgacaagaacaggggtaaaagtgataatgtgcctagcgaggaggtggtgaaaaaaatgaagaactactggcgacagctgcttaatgcaaagctcattacacaacggaagttcgataatctgacgaaagcagagagaggtggcttgtctgagttggacaaggcagggtttattaagcggcagctggtggaaactaggcagatcacaaagcacgtggcgcagattttggacagccggatgaacacaaaatacgacgaaaatgataaactgatacgagaggtcaaagttatcacgctgaaaagcaagctggtgtccgattttcggaaagacttccagttctacaaagttcgcgagattaataactaccatcatgctcacgatgcgtacctgaacgctgttgtcgggaccgccttgataaagaagtacccaaagctggaatccgagttcgtatacggggattacaaagtgtacgatgtgaggaaaatgatagccaagtccgagcaggagattggaaaggccacagctaagtacttcttttattctaacatcatgaatttttttaagacggaaattaccctggccaacggagagatcagaaagcggccccttatagagacaaatggtgaaacaggtgaaatcgtctgggataagggcagggatttcgctactgtgaggaaggtgctgagtatgccacaggtaaatatcgtgaaaaaaaccgaagtacagaccggaggattttccaaggaaagcattttgcctaaaagaaactcagacaagctcatcgcccgcaagaaagattgggaccctaagaaatacgggggatttgactcacccaccgtagcctattctgtgctggtggtagctaaggtggaaaaaggaaagtctaagaagctgaagtccgtgaaggaactcttgggaatcactatcatggaaagatcatcctttgaaaagaaccctatcgatttcctggaggctaagggttacaaggaggtcaagaaagacctcatcattaaactgccaaaatactctctcttcgagctggaaaatggcaggaagagaatgttggccagcgccggagagctgcaaaagggaaacgagcttgctctgccctccaaatatgttaattttctctatctcgcttcccactatgaaaagctgaaagggtctcccgaagataacgagcagaagcagctgttcgtcgaacagcacaagcactatctggatgaaataatcgaacaaataagcgagttcagcaaaagggttatcctggcggatgctaatttggacaaagtactgtctgcttataacaagcaccgggataagcctattagggaacaagccgagaatataattcacctctttacactcacgaatctcggagcccccgccgccttcaaatactttgatacgactatcgaccggaaacggtataccagtaccaaagaggtcctcgatgccaccctcatccaccagtcaattactggcctgtacgaaacacggatcgacctctctcaactgggcggcgactag

SEQ ID NO: 4 - protein, 1388 aa, Streptococcus thermophilus
  misc_feature (10)..(21): N-terminal RuvC-like domain
  misc_feature (760)..(767): RuvC-like domain
  misc_feature (844)..(870): HNH-like domain
  misc_feature (989)..(996): RuvC-like domain
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 5 - protein, 1334 aa, Listeria innocua
  misc_feature (10)..(21): N-terminal RuvC-like domain
  misc_feature (762)..(769): RuvC-like domain
  misc_feature (840)..(866): HNH-like domain
  misc_feature (985)..(992): RuvC-like domain
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 6 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 7 - DNA, 3159 bp, Staphylococcus aureus
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 8 - DNA, 3159 bp, Staphylococcus aureus
atgaagcggaactacatcctgggcctggacatcggcatcaccagcgtgggctacggcatcatcgactacgagacacgggacgtgatcgatgccggcgtgcggctgttcaaagaggccaacgtggaaaacaacgagggcaggcggagcaagagaggcgccagaaggctgaagcggcggaggcggcatagaatccagagagtgaagaagctgctgttcgactacaacctgctgaccgaccacagcgagctgagcggcatcaacccctacgaggccagagtgaagggcctgagccagaagctgagcgaggaagagttctctgccgccctgctgcacctggccaagagaagaggcgtgcacaacgtgaacgaggtggaagaggacaccggcaacgagctgtccaccaaagagcagatcagccggaacagcaaggccctggaagagaaatacgtggccgaactgcagctggaacggctgaagaaagacggcgaagtgcggggcagcatcaacagattcaagaccagcgactacgtgaaagaagccaaacagctgctgaaggtgcagaaggcctaccaccagctggaccagagcttcatcgacacctacatcgacctgctggaaacccggcggacctactatgagggacctggcgagggcagccccttcggctggaaggacatcaaagaatggtacgagatgctgatgggccactgcacctacttccccgaggaactgcggagcgtgaagtacgcctacaacgccgacctgtacaacgccctgaacgacctgaacaatctcgtgatcaccagggacgagaacgagaagctggaatattacgagaagttccagatcatcgagaacgtgttcaagcagaagaagaagcccaccctgaagcagatcgccaaagaaatcctcgtgaacgaagaggatattaagggctacagagtgaccagcaccggcaagcccgagttcaccaacctgaaggtgtaccacgacatcaaggacattaccgcccggaaagagattattgagaacgccgagctgctggatcagattgccaagatcctgaccatctaccagagcagcgaggacatccaggaagaactgaccaatctgaactccgagctgacccaggaagagatcgagcagatctctaatctgaagggctataccggcacccacaacctgagcctgaaggccatcaacctgatcctggacgagctgtggcacaccaacgacaaccagatcgctatcttcaaccggctgaagctggtgcccaagaaggtggacctgtcccagcagaaagagatccccaccaccctggtggacgacttcatcctgagccccgtcgtgaagagaagcttcatccagagcatcaaagtgatcaacgccatcatcaagaagtacggcctgcccaacgacatcattatcgagctggcccgcgagaagaactccaaggacgcccagaaaatgatcaacgagatgcagaagcggaaccggcagaccaacgagcggatcgaggaaatcatccggaccaccggcaaagagaacgccaagtacctgatcgagaagatcaagctgcacgacatgcaggaaggcaagtgcctgtacagcctggaagccatccctctggaagatctgctgaacaaccccttcaactatgaggtggaccacatcatccccagaagcgtgtccttcgacaacagcttcaacaacaaggtgctcgtgaagcaggaagaaaacagcaagaagggcaaccggaccccattccagtacctgagcagcagcgacagcaagatcagctacgaaaccttcaagaagcacatcctgaatctggccaagggcaagggcagaatcagcaagaccaagaaagagtatctgctggaagaacgggacatcaacaggttctccgtgcagaaagacttcatcaaccggaacctggtggataccagatacgccaccagaggcctgatgaacctgctgcggagctacttcagagtgaacaacctggacgtgaaagtgaagtccatcaatggcggcttcaccagctttctgcggcggaagtggaagtttaagaaagagcggaacaaggggtacaagcaccacgccgaggacgccctgatcattgccaacgccgatttcatcttcaaagagtggaagaaactggacaaggccaaaaaagtgatggaaaaccagatgttcgaggaaaagcaggccgagagcatgcccgagatcgaaaccgagcaggagtacaaagagatcttcatcaccccccaccagatcaagcacattaaggacttcaaggactacaagtacagccaccgggtggacaagaagcctaatagagagctgattaacgacaccctgtactccacccggaaggacgacaagggcaacaccctgatcgtgaacaatctgaacggcctgtacgacaaggacaatgacaagctgaaaaagctgatcaacaagagccccgaaaagctgctgatgtaccaccacgacccccagacctaccagaaactgaagctgattatggaacagtacggcgacgagaagaatcccctgtacaagtactacgaggaaaccgggaactacctgaccaagtactccaaaaaggacaacggccccgtgatcaagaagattaagtattacggcaacaaactgaacgcccatctggacatcaccgacgactaccccaacagcagaaacaaggtcgtgaagctgtccctgaagccctacagattcgacgtgtacctggacaatggcgtgtacaagttcgtgaccgtgaagaatctggatgtgatcaaaaaagaaaactactacgaagtgaatagcaagtgctatgaggaagctaagaagctgaagaagatcagcaaccaggccgagtttatcgcctccttctacaacaacgatctgatcaagatcaacggcgagctgtatagagtgatcggcgtgaacaacgacctgctgaaccggatcgaagtgaacatgatcgacatcacctaccgcgagtacctggaaaacatgaacgacaagaggccccccaggatcattaagacaatcgcctccaagacccagagcattaagaagtacagcacagacattctgggcaacctgtatgaagtgaaatctaagaagcaccctcagatcatcaaaaagggc

SEQ ID NO: 9 - DNA, 3159 bp, Staphylococcus aureus
atgaagcgcaactacatcctcggactggacatcggcattacctccgtgggatacggcatcatcgattacgaaactagggatgtgatcgacgctggagtcaggctgttcaaagaggcgaacgtggagaacaacgaggggcggcgctcaaagaggggggcccgccggctgaagcgccgccgcagacatagaatccagcgcgtgaagaagctgctgttcgactacaaccttctgaccgaccactccgaactttccggcatcaacccatatgaggctagagtgaagggattgtcccaaaagctgtccgaggaagagttctccgccgcgttgctccacctcgccaagcgcaggggagtgcacaatgtgaacgaagtggaagaagataccggaaacgagctgtccaccaaggagcagatcagccggaactccaaggccctggaagagaaatacgtggcggaactgcaactggagcggctgaagaaagacggagaagtgcgcggctcgatcaaccgcttcaagacctcggactacgtgaaggaggccaagcagctcctgaaagtgcaaaaggcctatcaccaacttgaccagtcctttatcgatacctacatcgatctgctcgagactcggcggacttactacgagggtccaggggagggctccccatttggttggaaggatattaaggagtggtacgaaatgctgatgggacactgcacatacttccctgaggagctgcggagcgtgaaatacgcatacaacgcagacctgtacaacgcgctgaacgacctgaacaatctcgtgatcacccgggacgagaacgaaaagctcgagtattacgaaaagttccagattattgagaacgtgttcaaacagaagaagaagccgacactgaagcagattgccaaggaaatcctcgtgaacgaagaggacatcaagggctatcgagtgacctcaacgggaaagccggagttcaccaatctgaaggtctaccacgacatcaaagacattaccgcccggaaggagatcattgagaacgcggagctgttggaccagattgcgaagattctgaccatctaccaatcctccgaggatattcaggaagaactcaccaacctcaacagcgaactgacccaggaggagatagagcaaatctccaacctgaagggctacaccggaactcataacctgagcctgaaggccatcaacttgatcctggacgagctgtggcacaccaacgataaccagatcgctattttcaatcggctgaagctggtccccaagaaagtggacctctcacaacaaaaggagatccctactacccttgtggacgatttcattctgtcccccgtggtcaagagaagcttcatacagtcaatcaaagtgatcaatgccattatcaagaaatacggtctgcccaacgacattatcattgagctcgcccgcgagaagaactcgaaggacgcccagaagatgattaacgaaatgcagaagaggaaccgacagactaacgaacggatcgaagaaatcatccggaccaccgggaaggaaaacgcgaagtacctgatcgaaaagatcaagctccatgacatgcaggaaggaaagtgtctgtactcgctggaggccattccgctggaggacttgctgaacaacccttttaactacgaagtggatcatatcattccgaggagcgtgtcattcgacaattccttcaacaacaaggtcctcgtgaagcaggaggaaaactcgaagaagggaaaccgcacgccgttccagtacctgagcagcagcgactccaagatttcctacgaaaccttcaagaagcacatcctcaacctggcaaaggggaagggtcgcatctccaagaccaagaaggaatatctgctggaagaaagagacatcaacagattctccgtgcaaaaggacttcatcaaccgcaacctcgtggatactagatacgctactcggggtctgatgaacctcctgagaagctactttagagtgaacaatctggacgtgaaggtcaagtcgattaacggaggtttcacctccttcctgcggcgcaagtggaagttcaagaaggaacggaacaagggctacaagcaccacgccgaggacgccctgatcattgccaacgccgacttcatcttcaaagaatggaagaaacttgacaaggctaagaaggtcatggaaaaccagatgttcgaagaaaagcaggccgagtctatgcctgaaatcgagactgaacaggagtacaaggaaatctttattacgccacaccagatcaaacacatcaaggatttcaaggattacaagtactcacatcgcgtggacaaaaagccgaacagggaactgatcaacgacaccctctactccacccggaaggatgacaaagggaataccctcatcgtcaacaaccttaacggcctgtacgacaaggacaacgataagctgaagaagctcattaacaagtcgcccgaaaagttgctgatgtaccaccacgaccctcagacttaccagaagctcaagctgatcatggagcagtatggggacgagaaaaacccgttgtacaagtactacgaagaaactgggaattatctgactaagtactccaagaaagataacggccccgtgattaagaagattaagtactacggcaacaagctgaacgcccatctggacatcaccgatgactaccctaattcccgcaacaaggtcgtcaagctgagcctcaagccctaccggtttgatgtgtaccttgacaatggagtgtacaagttcgtgactgtgaagaaccttgacgtgatcaagaaggagaactactacgaagtcaactccaagtgctacgaggaagcaaagaagttgaagaagatctcgaaccaggccgagttcattgcctccttctataacaacgacctgattaagatcaacggcgaactgtaccgcgtcattggcgtgaacaacgatctcctgaaccgcatcgaagtgaacatgatcgacatcacttaccgggaatacctggagaatatgaacgacaagcgcccgccccggatcattaagactatcgcctcaaagacccagtcgatcaagaagtacagcaccgacatcctgggcaacctgtacgaggtcaaatcgaagaagcacccccagatcatcaagaaggga

SEQ ID NO: 10 - DNA, 3159 bp, Staphylococcus aureus
atgaaaaggaactacattctggggctggccatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 11 - DNA, 3159 bp, Staphylococcus aureus
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagaggcctctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 12 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 13 - DNA, 3249 bp, Neisseria meningitidis
  misc_feature (1)..(3249): Exemplary codon optimized Cas9
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 14 - protein, 859 aa, Artificial Sequence
  Synthetic Cas9 consensus sequence derived from Sm, Sp, St, and Li Cas9 sequences
  misc_feature (4)..(4): Xaa can be any naturally occurring amino acid
  misc_feature (8)..(18): N-terminal RuvC-like domain
  misc_feature (21)..(21): Xaa can be any naturally occurring amino acid
  misc_feature (23)..(23): Xaa can be any naturally occurring amino acid
  misc_feature (24)..(24): Xaa can be any naturally occurring amino acid
  misc_feature (26)..(26): Xaa can be any naturally occurring amino acid
  misc_feature (29)..(31): Each Xaa can independently be any naturally occurring amino acid
  misc_feature (33)..(33): Xaa can be any naturally occurring amino acid
  misc_feature (36)..(36): Xaa can be any naturally occurring amino acid
  misc_feature (45)..(45): Xaa can be any naturally occurring amino acid
  misc_feature (54)..(54): Xaa can be any naturally occurring amino acid
  misc_feature (63)..(63): Xaa can be any naturally occurring amino acid
  misc_feature (71)..(71): Xaa can be any naturally occurring amino acid
  misc_feature (75)..(75): Xaa can be any naturally occurring amino acid
  misc_feature (76)..(76): Xaa can be any naturally occurring amino acid
  misc_feature (78)..(80): Each Xaa can independently be any naturally occurring amino acid
  misc_feature (82)..(82): Xaa can be any naturally occurring amino acid
  misc_feature (84)..(84): Xaa can be any naturally occurring amino acid
  misc_feature (85)..(85): Xaa can be any naturally occurring amino acid
  misc_feature (89)..(89): Xaa can be any naturally occurring amino acid
  misc_feature (90)..(90): Xaa can be any naturally occurring amino acid
  misc_feature (98)..(98): Xaa can be any naturally occurring amino acid
  misc_feature (100)..(100): Xaa can be any naturally occurring amino acid
  misc_feature (106)..(106): Xaa can be any naturally occurring amino acid
  misc_feature (113)..(113): Xaa can be any naturally occurring amino acid
  misc_feature (116)..(116): Xaa can be any naturally occurring amino acid
  misc_feature (125)..(125): Xaa can be any naturally occurring amino acid
  misc_feature (126)..(126): Xaa can be any naturally occurring amino acid
  misc_feature (128)..(133): Each Xaa can independently be any naturally occurring amino acid
  misc_feature (135)..(135): Xaa can be any naturally occurring amino acid
  misc_feature (137)..(137): Xaa can be any naturally occurring amino acid
  misc_feature (139)..(147): Each Xaa can independently be any naturally occurring amino acid
  misc_feature (153)..(155): Each Xaa can independently be any naturally occurring amino acid
  misc_feature (157)..(157): Xaa can be any naturally occurring amino acid
  misc_feature (159)..(159): Xaa can be any naturally occurring amino acid
  misc_feature (161)..(161): Xaa can be any naturally occurring amino acid
  misc_feature (163)..(163): Xaa can be any naturally occurring amino acid
  misc_feature (166)..(168): Each Xaa can independently be any naturally occurring amino acid
  misc_feature (170)..(170): Xaa can be any naturally occurring amino acid
  misc_feature (171)..(171): Xaa can be any naturally occurring amino acid
  misc_feature (173)..(175): Each Xaa can independently be any naturally occurring amino acid
  misc_feature (177)..(177): Xaa can be any naturally occurring amino acid
  misc_feature (183)..(183): Xaa can be any naturally occurring amino acid
  misc_feature (185)..(187): Each Xaa can independently be any naturally occurring amino acid
  misc_feature (189)..(189): Xaa can be any naturally occurring amino acid
  misc_feature (192)..(195): Each Xaa can independently be any naturally occurring amino acid
  misc_feature (198)..(198): Xaa can be any naturally occurring amino acid
  misc_feature (199)..(199): Xaa can be any naturally occurring amino acid
  misc_feature (202)..(202): Xaa can be any naturally occurring amino acid
  misc_feature (206)..(206): Xaa can be any naturally occurring amino acid
  misc_feature (207)..(207): Xaa can be any naturally occurring amino acid
  misc_feature (210)..(210): Xaa can be any naturally occurring amino acid
  misc_feature (212)..(212): Xaa can be any naturally occurring amino acid
  misc_feature (213)..(213): Xaa can be any naturally occurring amino acid
  misc_feature (219)..(219): Xaa can be any naturally occurring amino acid
  misc_feature (220)..(220): Xaa can be any naturally occurring amino acid
  misc_feature (222)..(222): Xaa can be any naturally occurring amino acid
  misc_feature (224)..(224): Xaa can be any naturally occurring amino acid
  misc_feature (226)..(226): Xaa can be any naturally occurring amino acid
  misc_feature (236)..(236): Xaa can be any naturally occurring amino acid
  misc_feature (240)..(240): Xaa can be any naturally occurring amino acid
  misc_feature (241)..(241): Xaa can be any naturally occurring amino acid
  misc_feature (244)..(246): Each Xaa can independently be any naturally occurring amino acid
  misc_feature (248)..(248): Xaa can be any naturally occurring amino acid
  misc_feature (249)..(249): Xaa can be any naturally occurring amino acid
  misc_feature (250)..(250): Xaa can be any naturally occurring amino acid
  misc_feature (252)..(254): Each Xaa can independently be any naturally occurring amino acid
  misc_feature (256)..(256): Xaa can be any naturally occurring amino acid
  misc_feature (257)..(257): Xaa can be any naturally occurring amino acid
  misc_feature (268)..(268): Xaa can be any naturally occurring amino acid
  misc_feature (271)..(271): Xaa can be any naturally occurring amino acid
  misc_feature (273)..(273): Xaa can be any naturally occurring amino acid
  misc_feature (277)..(277): Xaa can be any naturally occurring amino acid
  misc_feature (280)..(280): Xaa can be any naturally occurring amino acid
  misc_feature (281)..(281): Xaa can be any naturally occurring amino acid
  misc_feature (283)..(283): Xaa can be any naturally occurring amino acid
  misc_feature (289)..(289): Xaa can be any naturally occurring amino acid
  misc_feature (290)..(290): Xaa can be any naturally occurring amino acid
  misc_feature (292)..(294): Each Xaa can independently be any naturally occurring amino acid
  misc_feature (301)..(301): Xaa can be any naturally occurring amino acid
  misc_feature (308)..(308): Xaa can be any naturally occurring amino acid
  misc_feature (319)..(322): Each Xaa can independently be any naturally occurring amino acid
  misc_feature (328)..(328): Xaa can be any naturally occurring amino acid
  misc_feature (329)..(329): Xaa can be any naturally occurring amino acid
  misc_feature (335)..(337): Each Xaa can independently be any naturally occurring amino acid
  misc_feature (346)..(346): Xaa can be any naturally occurring amino acid
  misc_feature (347)..(347): Xaa can be any naturally occurring amino acid
  misc_feature (356)..(361): Each Xaa can independently be any naturally occurring amino acid
  misc_feature (363)..(363): Xaa can be any naturally occurring amino acid
  misc_feature (370)..(373): Each Xaa can independently be any naturally occurring amino acid
  misc_feature (375)..(375): Xaa can be any naturally occurring amino acid
  misc_feature (376)..(376): Xaa can be any naturally occurring amino acid
  misc_feature (379)..(379): Xaa can be any naturally occurring amino acid
  misc_feature (386)..(390): Each Xaa can independently be any naturally occurring amino acid
  misc_feature (393)..(393): Xaa can be any naturally occurring amino acid
  misc_feature (395)..(395): Xaa can be any naturally occurring amino acid
  misc_feature (396)..(396): Xaa can be any naturally occurring amino acid
  misc_feature (398)..(398): Xaa can be any naturally occurring amino acid
  misc_feature (400)..(400): Xaa can be any naturally occurring amino acid
  misc_feature (403)..(403): Xaa can be any naturally occurring amino acid
  misc_feature (407)..(407): Xaa can be any naturally occurring amino acid
  misc_feature (410)..(410): Xaa can be any naturally occurring amino acid
  misc_feature (411)..(411): Xaa can be any naturally occurring amino acid
  misc_feature (413)..(416): Each Xaa can independently be any naturally occurring amino acid
  misc_feature (418)..(418): Xaa can be any naturally occurring amino acid
  misc_feature (422)..(422): Xaa can be any naturally occurring amino acid
  misc_feature (428)..(428): Xaa can be any naturally occurring amino acid
  misc_feature (431)..(431): Xaa can be any naturally occurring amino acid
  misc_feature (433)..(433): Xaa can be any naturally occurring amino acid
  misc_feature (437)..(439): Each Xaa can independently be any naturally occurring amino acid
  misc_feature (445)..(445): Xaa can be any naturally occurring amino acid
  misc_feature (451)..(451): Xaa can be any naturally occurring amino acid
  misc_feature (456)..(456): Xaa can be any naturally occurring amino acid
  misc_feature (459)..(459): Xaa can be any naturally occurring amino acid
  misc_feature (465)..(469): Each Xaa can independently be any naturally occurring amino acid
  misc_feature (481)..(481): Xaa can be any naturally occurring amino acid
  misc_feature (482)..(482): Xaa can be any naturally occurring amino acid
  misc_feature (484)..(484): Xaa can be any naturally occurring amino acid
  misc_feature (490)..(490): Xaa can be any naturally occurring amino acid
  misc_feature (494)..(494): Xaa can be any naturally occurring amino acid
  misc_feature (495)..(502): RuvC-like domain
  misc_feature (497)..(497): Xaa can be any naturally occurring amino acid
  misc_feature (506)..(506): Xaa can be any naturally occurring amino acid
  misc_feature (510)..(510): Xaa can be any naturally occurring amino acid
  misc_feature (513)..(513): Xaa can be any naturally occurring amino acid
  misc_feature (514)..(514): Xaa can be any naturally occurring amino acid
  misc_feature (517)..(517): Xaa can be any naturally occurring amino acid
  misc_feature (520)..(520): Xaa can be any naturally occurring amino acid
  misc_feature (525)..(525): Xaa can be any naturally occurring amino acid
  misc_feature (526)..(526): Xaa can be any naturally occurring amino acid
  misc_feature (529)..(529): Xaa can be any naturally occurring amino acid
  misc_feature (531)..(531): Xaa can be any naturally occurring amino acid
  misc_feature (532)..(532): Xaa can be any naturally occurring amino acid
  misc_feature (534)..(534): Xaa can be any naturally occurring amino acid
  misc_feature (542)..(542): Xaa can be any naturally occurring amino acid
  misc_feature (546)..(546): Xaa can be any naturally occurring amino acid
  misc_feature (547)..(547): Xaa can be any naturally occurring amino acid
  misc_feature (553)..(553): Xaa can be any naturally occurring amino acid
  misc_feature (555)..(575): HNH-like domain
  misc_feature (556)..(556): Xaa can be any naturally occurring amino acid
  misc_feature (560)..(560): Xaa can be any naturally occurring amino acid
  misc_feature (563)..(563): Xaa can be any naturally occurring amino acid
  misc_feature (565)..(565): Xaa can be any naturally occurring amino acid
  misc_feature (567)..(567): Xaa can be any naturally occurring amino acid
  misc_feature (579)..(579): Xaa can be any naturally occurring amino acid
  misc_feature (582)..(582): Xaa can be any naturally occurring amino acid
  misc_feature (583)..(583): Xaa can be any naturally occurring amino acid
  misc_feature (585)..(585): Xaa can be any naturally occurring amino acid
  misc_feature (588)..(588): Xaa can be any naturally occurring amino acid
  misc_feature (590)..(590): Xaa can be any naturally occurring amino acid
  misc_feature (592)..(592): Xaa can be any naturally occurring amino acid
  misc_feature (594)..(596): Each Xaa can independently be any naturally occurring amino acid
  misc_feature (610)..(610): Xaa can be any naturally occurring amino acid
  misc_feature (616)..(616): Xaa can be any naturally occurring amino acid
  misc_feature (628)..(628): Xaa can be any naturally occurring amino acid
  misc_feature (631)..(631): Xaa can be any naturally occurring amino acid
  misc_feature (633)..(633): Xaa can be any naturally occurring amino acid
  misc_feature (634)..(634): Xaa can be any naturally occurring amino acid
  misc_feature (636)..(636): Xaa can be any naturally occurring amino acid
  misc_feature (638)..(641): Each Xaa can independently be any naturally occurring amino acid
  misc_feature (643)..(645): Each Xaa can independently be any naturally occurring amino acid
  misc_feature (653)..(653): Xaa can be any naturally occurring amino acid
  misc_feature (657)..(657): Xaa can be any naturally occurring amino acid
  misc_feature (659)..(659): Xaa can be any naturally occurring amino acid
  misc_feature (660)..(660): Xaa can be any naturally occurring amino acid
  misc_feature (665)..(665): Xaa can be any naturally occurring amino acid
  misc_feature (666)..(666): Xaa can be any naturally occurring amino acid
  misc_feature (668)..(668): Xaa can be any naturally occurring amino acid
  misc_feature (669)..(669): Xaa can be any naturally occurring amino acid
  misc_feature (670)..(677): RuvC-like domain
  misc_feature (680)..(680): Xaa can be any naturally occurring amino acid
  misc_feature (681)..(681): Xaa can be any naturally occurring amino acid
  misc_feature (683)..(683): Xaa can be any naturally occurring amino acid
  misc_feature (686)..(686): Xaa can be any naturally occurring amino acid
  misc_feature (696)..(696): Xaa can be any naturally occurring amino acid
  misc_feature (697)..(697): Xaa can be any naturally occurring amino acid
  misc_feature (704)..(704): Xaa can be any naturally occurring amino acid
  misc_feature (708)..(708): Xaa can be any naturally occurring amino acid
  misc_feature (710)..(710): Xaa can be any naturally occurring amino acid
  misc_feature (711)..(711): Xaa can be any naturally occurring amino acid
  misc_feature (714)..(714): Xaa can be any naturally occurring amino acid
  misc_feature (717)..(720): Each Xaa can independently be any naturally occurring amino acid
  misc_feature (722)..(722): Xaa can be any naturally occurring amino acid
  misc_feature (725)..(725): Xaa can be any naturally occurring amino acid
  misc_feature (727)..(727): Xaa can be any naturally occurring amino acid
  misc_feature (733)..(735): Each Xaa can independently be any naturally occurring amino acid
  misc_feature (740)..(740): Xaa can be any naturally occurring amino acid
  misc_feature (742)..(742): Xaa can be any naturally occurring amino acid
  misc_feature (749)..(754): Each Xaa can independently be any naturally occurring amino acid
  misc_feature (758)..(761): Each Xaa can independently be any naturally occurring amino acid
  misc_feature (763)..(768): Each Xaa can independently be any naturally occurring amino acid
  misc_feature (771)..(771): Xaa can be any naturally occurring amino acid
  misc_feature (774)..(777): Each Xaa can independently be any naturally occurring amino acid
  misc_feature (782)..(782): Xaa can be any naturally occurring amino acid
  misc_feature (784)..(786): Each Xaa can independently be any naturally occurring amino acid
  misc_feature (788)..(788): Xaa can be any naturally occurring amino acid
  misc_feature (790)..(790): Xaa can be any naturally occurring amino acid
  misc_feature (795)..(795): Xaa can be any naturally occurring amino acid
  misc_feature (799)..(799): Xaa can be any naturally occurring amino acid
  misc_feature (801)..(801): Xaa can be any naturally occurring amino acid
  misc_feature (802)..(802): Xaa can be any naturally occurring amino acid
  misc_feature (804)..(804): Xaa can be any naturally occurring amino acid
  misc_feature (806)..(813): Each Xaa can independently be any naturally occurring amino acid
  misc_feature (815)..(818): Each Xaa can independently be any naturally occurring amino acid
  misc_feature (820)..(820): Xaa can be any naturally occurring amino acid
  misc_feature (823)..(827): Each Xaa can independently be any naturally occurring amino acid
  misc_feature (829)..(829): Xaa can be any naturally occurring amino acid
  misc_feature (830)..(830): Xaa can be any naturally occurring amino acid
  misc_feature (832)..(832): Xaa can be any naturally occurring amino acid
  misc_feature (835)..(837): Each Xaa can independently be any naturally occurring amino acid
  misc_feature (842)..(844): Each Xaa can independently be any naturally occurring amino acid
  misc_feature (846)..(846): Xaa can be any naturally occurring amino acid
  misc_feature (848)..(848): Xaa can be any naturally occurring amino acid
  misc_feature (851)..(851): Xaa can be any naturally occurring amino acid
  misc_feature (857)..(857): Xaa can be any naturally occurring amino acid
  misc_feature (857)..(857): Xaa can be any naturally occurring amino acid
MKYXIGLDIGTNSVGWAVTDXYXXKXKGXXXIXKNXGLFDGTARXRTARRRRRXNRIYLQIFXEMDFFRLXSFVXXKXXXPXFXXEYHXXPTIYHLRXLXKDLRLXYLALAHXIKXRGNFLIEGXXNXXXXXXYXFXIXXXXXXXXXPEKGFXXXLXGXFXFXLEXXXKXXYXXXLXLLIGDXYXXXFXAKXXXXLSXXVTXALSXXMIXRXXHDLLKXXYXEXFXKGYAGYIDGXQFYXXKLXXXGXXXKXXXEXXLRKQRTFDNGXIPXQXHLEXAIXXQXYPFLNXXIXXXTFRIPYXVGPLAGXSFAWRKIPWNXXXXDSAFIXXMTDLPXXXVLPKHSLYXXVYNELTKVXXXXXXKXIFKRKVXXXXGXXFNXSTYHDLXXXXXLDXNXXEXIXLTXFEDXMIXXLXXXXKXLRRXYTGWGXLSXLXGIRXXXSTILDXLDNRNXMQLIXDLXFKIKQXXXXXGSPAIKKGILQXXKXVDELVXMGPXIVXEMARENQTXGNSXRKXXKEXGSXILKEXXNLXNXXLXLYYLQNGXDMYXXLDILSXYDXDHIXPQXFXDXSIDNVLSNRKDXVPXXVXKKXWXLXLXXXRKFDLTKAERGGLXDKAFIXRQLVETRQITKXVAXLXXNXDXXXXVXXXTLKSLVSXFRKXFXXLYKVXXNXXHHAHDAYLNVXXLXYPXLEEFVYGDYXXKATKFYXNIMXFXXGEXWKXXXXVXMQXNXVKKEQXXXPKNSXLXKDKYGGXXXXXXKGKXXXXIXXXXXXFLXGYXXXXLPKYXLXXXGXRXLASEXKGNXLXXLXAXXXXXXXXEXXXXFXANXXXXXLXXGXAFXXXIRRYXXXTXIXQSXTGLYEXRL

SEQ ID NO: 15 - protein, 8 aa, Artificial Sequence
  RuvC-like domain
  VARIANT (2)..(2): Xaa is Val or His
  VARIANT (3)..(3): Xaa is Ile, Leu, or Val
  VARIANT (5)..(5): Xaa is Met or Thr
IXXEXARE

SEQ ID NO: 16 - protein, 8 aa, Artificial Sequence
  RuvC-like domain
  VARIANT (3)..(3): Xaa is Ile, Leu, or Val
IVXEMARE

SEQ ID NO: 17 - protein, 8 aa, Artificial Sequence
  RuvC-like domain
  VARIANT (4)..(4): Xaa is His or Leu
  VARIANT (7)..(7): Xaa is Arg or Val
  VARIANT (8)..(8): Xaa is Glu or Val
HHAXDAXX

SEQ ID NO: 18 - protein, 8 aa, Artificial Sequence
  RuvC-like domain
HHAHDAYL

SEQ ID NO: 19 - protein, 30 aa, Artificial Sequence
  N-terminal RuvC-like domain
  VARIANT (2)..(2): Xaa is Lys or Pro
  VARIANT (4)..(4): Xaa is Val, Leu, Ile, or Phe
  VARIANT (5)..(5): Xaa is Gly, Ala, or Ser
  VARIANT (6)..(6): Xaa is Leu, Ile, Val, or Phe
  MOD_RES (7)..(26): N-terminal RuvC-like domain, each Xaa can be any amino acid or absent, region may encompass 5-20 residues
  VARIANT (29)..(29): Xaa is Asp, Glu, Asn, or Gln
KXYXXXXXXXXXXXXXXXXXXXXXXXTDXY

SEQ ID NO: 20 - protein, 12 aa, Artificial Sequence
  N-terminal RuvC-like domain
  VARIANT (2)..(2): Xaa is Ile, Val, Met, Leu, or Thr
  VARIANT (4)..(4): Xaa is Thr, Ile, Val, Ser, Asn, Tyr, Glu, or Leu
  VARIANT (5)..(5): Xaa is Asn, Ser, Gly, Ala, Asp, Thr, Arg, Met, or Phe
  VARIANT (6)..(6): Xaa is Ser, Tyr, Asn, or Phe
  VARIANT (7)..(7): Xaa is Val, Ile, Leu, Cys, Thr, or Phe
  VARIANT (9)..(9): Xaa is Trp, Phe, Val, Tyr, Ser, or Leu
  VARIANT (10)..(10): Xaa is Ala, Ser, Cys, Val, or Gly
  VARIANT (11)..(11): Xaa is Val, Ile, Leu, Ala, Met, or His
  VARIANT (12)..(12): Any amino acid or absent
DXGXXXXGXXXX

SEQ ID NO: 21 - protein, 12 aa, Artificial Sequence
  N-terminal RuvC-like domain
  VARIANT (2)..(2): Xaa is Ile, Val, Met, Leu, or Thr
  VARIANT (4)..(4): Xaa is Thr, Ile, Val, Ser, Asn, Tyr, Glu, or Leu
  VARIANT (5)..(5): Xaa is Asn, Ser, Gly, Ala, Asp, Thr, Arg, Met, or Phe
  VARIANT (7)..(7): Xaa is Val, Ile, Leu, Cys, Thr, or Phe
  VARIANT (9)..(9): Xaa is Trp, Phe, Val, Tyr, Ser, or Leu
  VARIANT (10)..(10): Xaa is Ala, Ser, Cys, Val, or Gly
  VARIANT (11)..(11): Xaa is Val, Ile, Leu, Ala, Met, or His
  VARIANT (12)..(12): Any amino acid or absent
DXGXXSXGXXXX

SEQ ID NO: 22 - protein, 12 aa, Artificial Sequence
  N-terminal RuvC-like domain
  VARIANT (4)..(4): Xaa is Thr, Ile, Val, Ser, Asn, Tyr, Glu, or Leu
  VARIANT (5)..(5): Xaa is Asn, Ser, Gly, Ala, Asp, Thr, Arg, Met, or Phe
  VARIANT (11)..(11): Xaa is Val, Ile, Leu, Ala, Met, or His
  VARIANT (12)..(12): Any amino acid or absent
DIGXXSVGWAXX

SEQ ID NO: 23 - protein, 12 aa, Artificial Sequence
  N-terminal RuvC-like domain
  MOD_RES (12)..(12): Any non-polar alkyl amino acid or a hydroxyl amino acid
DIGTNSVGWAVX

SEQ ID NO: 24 - protein, 73 aa, Artificial Sequence
  HNH-like domain
  VARIANT (8)..(8): Xaa is Lys or Arg
  VARIANT (12)..(12): Xaa is Val or Thr
  VARIANT (13)..(13): Xaa is Gly or Asp
  VARIANT (14)..(14): Xaa is Glu, Gln, or Asp
  VARIANT (15)..(15): Xaa is Glu or Asp
  VARIANT (19)..(19): Xaa is Asp, Asn, or His
  VARIANT (20)..(20): Xaa is Tyr, Arg, or Asn
  VARIANT (23)..(23): Xaa is Gln, Asp, or Asn
  MOD_RES (25)..(64): HNH-like domain, each Xaa can be any amino acid or absent, region may encompass 15-40 residues
  VARIANT (67)..(67): Xaa is Gly or Glu
  VARIANT (69)..(69): Xaa is Ser or Gly
  VARIANT (71)..(71): Xaa is Asp or Asn
LYYLQNGXDMYXXXXLDIXXLSXYXXXXXXXXXXXXXXXXXXXXXXXXXXXXXXXXXXXXXXXXNRXKXDXVP

SEQ ID NO: 25 - protein, 27 aa, Artificial Sequence
  HNH-like domain
  VARIANT (1)..(1): Xaa is Asp, Glu, Gln, or Asn
  VARIANT (2)..(2): Xaa is Leu, Ile, Arg, Gln, Val, Met, or Lys
  VARIANT (3)..(3): Xaa is Asp or Glu
  VARIANT (5)..(5): Xaa is Ile, Val, Thr, Ala, or Leu
  VARIANT (6)..(6): Xaa is Val, Tyr, Ile, Leu, Phe, or Trp
  VARIANT (8)..(8): Xaa is Gln, His, Arg, Lys, Tyr, Ile, Leu, Phe, or Trp
  VARIANT (9)..(9): Xaa is Ser, Ala, Asp, Thr, or Lys
  VARIANT (10)..(10): Xaa is Phe, Leu, Val, Lys, Tyr, Met, Ile, Arg, Ala, Glu, Asp, or Gln
  VARIANT (11)..(11): Xaa is Leu, Arg, Thr, Ile, Val, Ser, Cys, Tyr, Lys, Phe, or Gly
  VARIANT (12)..(12): Xaa is Lys, Gln, Tyr, Thr, Phe, Leu, Trp, Met, Ala, Glu, Gly, or Ser
  VARIANT (13)..(13): Xaa is Asp, Ser, Asn, Arg, Leu, or Thr
  VARIANT (14)..(14): Xaa is Asp, Asn, or Ser
  VARIANT (15)..(15): Xaa is Ser, Ala, Thr, Gly, or Arg
  VARIANT (16)..(16): Xaa is Ile, Leu, Phe, Ser, Arg, Tyr, Gln, Trp, Asp, Lys, or His
  VARIANT (17)..(17): Xaa is Asp, Ser, Ile, Asn, Glu, Ala, His, Phe, Leu, Gln, Met, Gly, Tyr, or Val
  VARIANT (19)..(19): Xaa is Lys, Leu, Arg, Met, Thr, or Phe
  VARIANT (20)..(20): Xaa is Val, Leu, Ile, Ala, or Thr
  VARIANT (21)..(21): Xaa is Leu, Ile, Val, or Ala
  VARIANT (22)..(22): Xaa is Thr, Val, Cys, Glu, Ser, or Ala
  VARIANT (23)..(23): Xaa is Arg, Phe, Thr, Trp, Glu, Leu, Asn, Cys, Lys, Val, Ser, Gln, Ile, Tyr, His, or Ala
  VARIANT (24)..(24): Xaa is Ser, Pro, Arg, Lys, Asn, Ala, His, Gln, Gly, or Leu
  VARIANT (25)..(25): Xaa is Asp, Gly, Thr, Asn, Ser, Lys, Ala, Ile, Glu, Leu, Gln, Arg, or Tyr
  VARIANT (26)..(26): Xaa is Lys, Val, Ala, Glu, Tyr, Ile, Cys, Leu, Ser, Thr, Gly, Lys, Met, Asp, or Phe
XXXHXXPXXXXXXXXXXNXXXXXXXXN

SEQ ID NO: 26 - protein, 27 aa, Artificial Sequence
  HNH-like domain
  VARIANT (1)..(1): Xaa is Asp or Glu
  VARIANT (2)..(2): Xaa is Leu, Ile, Arg, Gln, Val, Met, or Lys
  VARIANT (3)..(3): Xaa is Asp or Glu
  VARIANT (5)..(5): Xaa is Ile, Val, Thr, Ala, or Leu
  VARIANT (6)..(6): Xaa is Val, Tyr, Ile, Leu, Phe, or Trp
  VARIANT (8)..(8): Xaa is Gln, His, Arg, Lys, Tyr, Ile, Leu, Phe, or Trp
  VARIANT (10)..(10): Xaa is Phe, Leu, Val, Lys, Tyr, Met, Ile, Arg, Ala, Glu, Asp, or Gln
  VARIANT (11)..(11): Xaa is Leu, Arg, Thr, Ile, Val, Ser, Cys, Tyr, Lys, Phe, or Gly
  VARIANT (12)..(12): Xaa is Lys, Gln, Tyr, Thr, Phe, Leu, Trp, Met, Ala, Glu, Gly, or Ser
  VARIANT (16)..(16): Xaa is Ile, Leu, Phe, Ser, Arg, Tyr, Gln, Trp, Asp, Lys, or His
  VARIANT (17)..(17): Xaa is Asp, Ser, Ile, Asn, Glu, Ala, His, Phe, Leu, Gln, Met, Gly, Tyr, or Val
  VARIANT (22)..(22): Xaa is Thr, Val, Cys, Glu, Ser, or Ala
  VARIANT (23)..(23): Xaa is Arg, Phe, Thr, Trp, Glu, Leu, Asn, Cys, Lys, Val, Ser, Gln, Ile, Tyr, His, or Ala
  VARIANT (24)..(24): Xaa is Ser, Pro, Arg, Lys, Asn, Ala, His, Gln, Gly, or Leu
  VARIANT (25)..(25): Xaa is Asp, Gly, Thr, Asn, Ser, Lys, Ala, Ile, Glu, Leu, Gln, Arg, or Tyr
  VARIANT (26)..(26): Xaa is Lys, Val, Ala, Glu, Tyr, Ile, Cys, Leu, Ser, Thr, Gly, Lys, Met, Asp, or Phe
XXXHXXPXSXXXDDSXXNKVLXXXXXN

SEQ ID NO: 27 - protein, 27 aa, Artificial Sequence
  HNH-like domain
  VARIANT (1)..(1): Xaa is Asp or Glu
  VARIANT (3)..(3): Xaa is Asp or Glu
  VARIANT (8)..(8): Xaa is Gln, His, Arg, Lys, Tyr, Ile, Leu, or Trp
  VARIANT (10)..(10): Xaa is Phe, Leu, Val, Lys, Tyr, Met, Ile, Arg, Ala, Glu, Asp, or Gln
  VARIANT (11)..(11): Xaa is Leu, Arg, Thr, Ile, Val, Ser, Cys, Tyr, Lys, Phe, or Gly
  VARIANT (12)..(12): Xaa is Lys, Gln, Tyr, Thr, Phe, Leu, Trp, Met, Ala, Glu, Gly, or Ser
  VARIANT (16)..(16): Xaa is Ile, Leu, Phe, Ser, Arg, Tyr, Gln, Trp, Asp, Lys, or His
  VARIANT (17)..(17): Xaa is Asp, Ser, Ile, Asn, Glu, Ala, His, Phe, Leu, Gln, Met, Gly, Tyr, or Val
  VARIANT (23)..(23): Xaa is Arg, Phe, Thr, Trp, Glu, Leu, Asn, Cys, Lys, Val, Ser, Gln, Ile, Tyr, His, or Ala
  VARIANT (24)..(24): Xaa is Ser, Pro, Arg, Lys, Asn, Ala, His, Gln, Gly, or Leu
  VARIANT (25)..(25): Xaa is Asp, Gly, Thr, Asn, Ser, Lys, Ala, Ile, Glu, Leu, Gln, Arg, or Tyr
  VARIANT (26)..(26): Xaa is Lys, Val, Ala, Glu, Tyr, Ile, Cys, Leu, Ser, Thr, Gly, Lys, Met, Asp, or Phe
XVXHIVPXSXXXDDSXXNKVLTXXXXN

SEQ ID NO: 28 - protein, 27 aa, Artificial Sequence
  HNH-like domain
  VARIANT (2)..(2): Xaa is Ile or Val
  VARIANT (6)..(6): Xaa is Ile or Val
  VARIANT (9)..(9): Xaa is Ala or Ser
  VARIANT (11)..(11): Xaa is Ile or Leu
  VARIANT (12)..(12): Xaa is Lys or Thr
  VARIANT (14)..(14): Xaa is Asp or Asn
  VARIANT (19)..(19): Xaa is Arg, Lys, or Leu
  VARIANT (22)..(22): Xaa is Thr or Val
  VARIANT (23)..(23): Xaa is Ser or Arg
  VARIANT (25)..(25): Xaa is Lys, Asp, or Ala
  VARIANT (26)..(26): Xaa is Glu, Lys, Gly, or Asn
DXDHIXPQXFXXDXSIDNXVLXXSXXN

SEQ ID NO: 29 - RNA, 116 nt, Artificial Sequence
  gRNA
  misc_feature (1)..(20): a, c, u, g, unknown or other
  misc_feature (1)..(20): targeting region
  misc_feature (21)..(42): first complementarity domain
  misc_feature (43)..(46): linking domain
  misc_feature (47)..(70): second complementarity domain
nnnnnnnnnnnnnnnnnnnnguuuuagagcuaugcuguuuuggaaacaaaacagcauagcaaguuaaaauaaggcuaguccguuaucaacuugaaaaaguggcaccgagucggugc

SEQ ID NO: 30 - RNA, 116 nt, Artificial Sequence
  gRNA
  misc_feature (1)..(20): a, c, u, g, unknown or other
  misc_feature (1)..(20): targeting region
  misc_feature (21)..(42): first complementarity domain
  misc_feature (43)..(46): linking domain
  misc_feature (47)..(70): second complementarity domain
nnnnnnnnnnnnnnnnnnnnguauuagagcuaugcuguauuggaaacaauacagcauagcaaguuaauauaaggcuaguccguuaucaacuugaaaaaguggcaccgagucggugc

SEQ ID NO: 31 - RNA, 96 nt, Artificial Sequence
  gRNA
  misc_feature (1)..(20): a, c, u, g, unknown or other
  misc_feature (1)..(20): targeting domain
  misc_feature (21)..(32): first complementarity domain
  misc_feature (33)..(36): linking domain
  misc_feature (37)..(50): second complementarity domain
  misc_feature (51)..(62): proximal domain
nnnnnnnnnnnnnnnnnnnnguuuaagagcuagaaauagcaaguuuaaauaaggcuaguccguuaucaacuugaaaaaguggcaccgagucggugc

SEQ ID NO: 32 - RNA, 47 nt, Artificial Sequence
  gRNA proximal and tail domains derived from S. pyogenes
aaggcuaguccguuaucaacuugaaaaaguggcaccgagucggugcu

SEQ ID NO: 33 - RNA, 49 nt, Artificial Sequence
  gRNA proximal and tail domains
aaggcuaguccguuaucaacuugaaaaaguggcaccgagucgguggugc

SEQ ID NO: 34 - RNA, 51 nt, Artificial Sequence
  gRNA proximal and tail domains
aaggcuaguccguuaucaacuugaaaaaguggcaccgagucggugcggauc

SEQ ID NO: 35 - RNA, 31 nt, Artificial Sequence
  gRNA proximal and tail domains
aaggcuaguccguuaucaacuugaaaaagug

SEQ ID NO: 36 - RNA, 18 nt, Artificial Sequence
  gRNA proximal and tail domains
aaggcuaguccguuauca

SEQ ID NO: 37 - RNA, 12 nt, Artificial Sequence
  gRNA proximal and tail domains
aaggcuaguccg

SEQ ID NO: 38 - RNA, 102 nt, Artificial Sequence
  Unimolecular gRNA derived from S. aureus
  misc_feature (1)..(20): n is a, c, g, or u
  misc_feature (1)..(20): Targeting domain
nnnnnnnnnnnnnnnnnnnnguuuuaguacucuggaaacagaaucuacuaaaacaaggcaaaaugccguguuuaucucgucaacuuguuggcgagauuuuuu

SEQ ID NO: 39 - RNA, 42 nt, Artificial
  Modular gRNA derived from S. pyogenes
  misc_feature (1)..(20): a, c, u, g, unknown or other
  misc_feature (1)..(20): Targeting domain
  misc_feature (21)..(42): First complementarity domain
nnnnnnnnnnnnnnnnnnnnguuuuagagcuaugcuguuuug

SEQ ID NO: 40 - RNA, 85 nt, Artificial Sequence
  Modular gRNA derived from S. pyogenes
  misc_feature (1)..(9): 5' extension domain
  misc_feature (10)..(33): Second complementarity domain
  misc_feature (34)..(45): Proximal domain
  misc_feature (46)..(85): Tail domain
ggaaccauucaaaacagcauagcaaguuaaaauaaggcuaguccguuaucaacuugaaaaaguggcaccgagucggugcuuuuuu

SEQ ID NO: 41 - RNA, 62 nt, Artificial Sequence
  Unimolecular gRNA derived from S. pyogenes
  misc_feature (1)..(20): a, c, u, g, unknown or other
  misc_feature (1)..(20): Targeting domain
  misc_feature (21)..(32): First complementarity domain
  misc_feature (33)..(36): Linking domain
  misc_feature (37)..(50): Second complementarity domain
  misc_feature (51)..(62): Proximal domain
nnnnnnnnnnnnnnnnnnnnguuuuagagcuagaaauagcaaguuaaaauaaggcuaguccg

SEQ ID NO: 42 - RNA, 102 nt, Artificial Sequence
  Unimolecular gRNA derived from S. pyogenes
  misc_feature (1)..(20): a, c, u, g, unknown or other
  misc_feature (1)..(20): Targeting domain
  misc_feature (21)..(32): First complementarity domain
  misc_feature (33)..(36): Linking domain
  misc_feature (37)..(50): Second complementarity domain
  misc_feature (51)..(62): Proximal domain
  misc_feature (63)..(102): Tail domain
nnnnnnnnnnnnnnnnnnnnguuuuagagcuagaaauagcaaguuaaaauaaggcuaguccguuaucaacuugaaaaaguggcaccgagucggugcuuuuuu

SEQ ID NO: 43 - RNA, 75 nt, Artificial Sequence
  Unimolecular gRNA derived from S. pyogenes
  misc_feature (1)..(20): Targeting domain
  misc_feature (1)..(20): a, c, u, g, unknown or other
  misc_feature (21)..(36): First complementarity domain
  misc_feature (37)..(40): Linking domain
  misc_feature (41)..(58): Second complementarity domain
  misc_feature (59)..(70): Proximal domain
  misc_feature (71)..(75): Tail domain
nnnnnnnnnnnnnnnnnnnnguuuuagagcuaugcugaaaagcauagcaaguuaaaauaaggcuaguccguuauc

SEQ ID NO: 44 - RNA, 87 nt, Artificial Sequence
  Unimolecular gRNA derived from S. pyogenes
  misc_feature (1)..(20): a, c, u, g, unknown or other
  misc_feature (1)..(20): Targeting domain
  misc_feature (21)..(32): First complementarity domain
  misc_feature (43)..(46): Linking domain
  misc_feature (57)..(70): Second complementarity domain
  misc_feature (71)..(82): Proximal domain
  misc_feature (83)..(87): Tail domain
nnnnnnnnnnnnnnnnnnnnguuuuagagcuaugcuguuuuggaaacaaaacagcauagcaaguuaaaauaaggcuaguccguuauc

SEQ ID NO: 45 - RNA, 42 nt, Artificial Sequence
  Modular gRNA derived from S. thermophilus
  misc_feature (1)..(20): a, c, u, g, unknown or other
  misc_feature (1)..(20): Targeting domain
  misc_feature (21)..(42): First complementarity domain
nnnnnnnnnnnnnnnnnnnnguuuuagagcuguguuguuucg

SEQ ID NO: 46 - RNA, 78 nt, Artificial Sequence
  Modular gRNA derived from S. thermophilus
  misc_feature (1)..(3): 5' extension domain
  misc_feature (4)..(27): Second complementarity domain
  misc_feature (28)..(40): Proximal domain
  misc_feature (41)..(78): Tail domain
gggcgaaacaacacagcgaguuaaaauaaggcuuaguccguacucaacuugaaaagguggcaccgauucgguguuuuu

SEQ ID NO: 47 - RNA, 85 nt, Artificial Sequence
  Modular gRNA derived from S. pyogenes
gaaccauucaaaacagcauagcaaguuaaaauaaggcuaguccguuaucaacuugaaaaaguggcaccgagucggugcuuuuuuu

SEQ ID NO: 48 - RNA, 96 nt, Artificial Sequence
  gRNA from S. pyogenes
  misc_feature (1)..(20): n is a, c, g, or u
  misc_feature (1)..(20): Targeting domain
nnnnnnnnnnnnnnnnnnnnguuuuagagcuagaaauagcaaguuaaaauaaggcuaguccguuaucaacuugaaaaaguggcaccgagucggugc

SEQ ID NO: 49 - RNA, 96 nt, Artificial Sequence
  gRNA
  misc_feature (1)..(20): n is a, c, g, or u
  misc_feature (1)..(20): Targeting domain
  misc_feature (21)..(32): First complementarity domain
  misc_feature (33)..(36): Linking domain
  misc_feature (37)..(50): Second complementarity domain
  misc_feature (51)..(62): Proximal domain
nnnnnnnnnnnnnnnnnnnnguauuagagcuagaaauagcaaguuaauauaaggcuaguccguuaucaacuugaaaaaguggcaccgagucggugc

SEQ ID NO: 50 - RNA, 104 nt, Artificial Sequence
  gRNA
  misc_feature (1)..(20): n is a, c, g, or u
  misc_feature (1)..(20): Targeting domain
  misc_feature (21)..(36): First complementarity domain
  misc_feature (37)..(40): Linking domain
  misc_feature (41)..(58): Second complementarity domain
nnnnnnnnnnnnnnnnnnnnguuuuagagcuaugcugaaaagcauagcaaguuaaaauaaggcuaguccguuaucaacuugaaaaaguggcaccgagucggugc

SEQ ID NO: 51 - RNA, 106 nt, Artificial Sequence
  gRNA
  misc_feature (1)..(20): n is a, c, g, or u
  misc_feature (1)..(20): Targeting domain
  misc_feature (21)..(37): First complementarity domain
  misc_feature (38)..(41): Linking domain
  misc_feature (42)..(60): Second complementarity domain
nnnnnnnnnnnnnnnnnnnnguuuuagagcuaugcuggaaacagcauagcaaguuaaaauaaggcuaguccguuaucaacuugaaaaaguggcaccgagucggugc

SEQ ID NO: 52 - protein, 12 aa, Peptoniphilus duerdenii
DIGTASVGWAVT

SEQ ID NO: 53 - protein, 12 aa, Treponema denticola
DVGTGSVGWAVT

SEQ ID NO: 54 - protein, 12 aa, S. mutans
DIGTNSVGWAVV

SEQ ID NO: 55 - protein, 12 aa, S. pyogenes
DIGTNSVGWAVI

SEQ ID NO: 56 - protein, 12 aa, L. innocua
DIGTNSVGWAVL

SEQ ID NO: 57 - protein, 12 aa, Flavobacterium branchiophilum FL-15
DLGTNSIGWAVV

SEQ ID NO: 58 - protein, 11 aa, Artificial Sequence
  N-terminal RuvC-like domain
DLGTNSIGWAI

SEQ ID NO: 59 - protein, 12 aa, Bacteroides fragilis, NCTC 9343
DLGTNSIGWALV

SEQ ID NO: 60 - protein, 12 aa, Fusobacterium nucleatum
DIGTNSVGWCVT

SEQ ID NO: 61 - protein, 12 aa, Acidaminococcus sp. D21
DIGTNSVGYAVT

SEQ ID NO: 62 - protein, 12 aa, Coprococcus catus GD-7
DMGTGSLGWAVT

SEQ ID NO: 63 - protein, 12 aa, Oenococcus kitaharae DSM 17330
DIGTSSVGWAAI

SEQ ID NO: 64 - protein, 12 aa, Catenibacterium mitsuokai DSM 15897
DLGTGSVGWAVV

SEQ ID NO: 65 - protein, 12 aa, Mycoplasma gallisepticum str. F
DLGVGSVGWAIV

SEQ ID NO: 66 - protein, 12 aa, Mycoplasma ovipneumoniae SC01
DLGIASIGWAII

SEQ ID NO: 67 - protein, 12 aa, Mycoplasma canis PG 14
DLGIASVGWAIV

SEQ ID NO: 68 - protein, 12 aa, Mycoplasma synoviae 53
DLGVASVGWSIV

SEQ ID NO: 69 - protein, 12 aa, Eubacterium rectale
DIGIASVGWAIL

SEQ ID NO: 70 - protein, 12 aa, Enterococcus faecalis TX0012
DLGISSVGWSVI

SEQ ID NO: 71 - protein, 12 aa, Ilyobacter polytropus DSM 2926
DIGIASVGWSVI

SEQ ID NO: 72 - protein, 12 aa, Ruminococcus albus 8
DVGIGSIGWAVI

SEQ ID NO: 73 - protein, 12 aa, Elusimicrobium minutum Pei191
DLGVGSIGFAIV

SEQ ID NO: 74 - protein, 12 aa, Akkermansia muciniphila
DIGYASIGWAVI

SEQ ID NO: 75 - protein, 12 aa, Artificial Sequence
  N-terminal RuvC-like domain
DTGTNSLGWAIV

SEQ ID NO: 76 - protein, 12 aa, Cand. Puniceispirillum marinum
DLGTNSIGWCLL

SEQ ID NO: 77 - protein, 12 aa, Rhodospirillum rubrum
DIGTDSLGWAVF

SEQ ID NO: 78 - protein, 12 aa, Lactobacillus rhamnosus GG
DIGSNSIGFAVV

SEQ ID NO: 79 - protein, 12 aa, Sphaerochaeta globus str. Buddy
DLGVGSIGVAVA

SEQ ID NO: 80 - protein, 12 aa, Artificial Sequence
  N-terminal RuvC-like domain
DLGIASCGWGVV

SEQ ID NO: 81 - protein, 12 aa, Mycoplasma mobile 163K
DLGIASVGWCLT

SEQ ID NO: 82 - protein, 12 aa, Streptococcus thermophilus LMD-9
DIGIGSVGVGIL

SEQ ID NO: 83 - protein, 12 aa, Staphylococcus lugdunensis M23590
DIGITSVGYGLI

SEQ ID NO: 84 - protein, 12 aa, Eubacterium dolichum DSM 3991
DIGITSVGFGII

SEQ ID NO: 85 - protein, 12 aa, Lactobacillus coryniformis KCTC 3535
DVGITSTGYAVL

SEQ ID NO: 86 - protein, 12 aa, Nitratifractor salsuginis DSM 16511
DLGITSFGYAIL

SEQ ID NO: 87 - protein, 12 aa, Bifidobacterium bifidum S17
DIGNASVGWSAF

SEQ ID NO: 88 - protein, 12 aa, Artificial Sequence
  N-terminal RuvC-like domain
DVGTNSCGWVAM

SEQ ID NO: 89 - protein, 12 aa, Acidothermus cellulolyticus 11B
DVGERSIGLAAV

SEQ ID NO: 90 - protein, 12 aa, Bifidobacterium longum DJO10A
DVGLNSVGLAAV

SEQ ID NO: 91 - protein, 12 aa, Artificial Sequence
  N-terminal RuvC-like domain
DVGLMSVGLAAI

SEQ ID NO: 92 - protein, 12 aa, Artificial Sequence
  N-terminal RuvC-like domain
DVGTFSVGLAAI

SEQ ID NO: 93 - protein, 12 aa, Staphylococcus pseudintermedius ED99
DIGTGSVGYACM

SEQ ID NO: 94 - protein, 12 aa, Artificial Sequence
  N-terminal RuvC-like domain
DLGTTSIGFAHI

SEQ ID NO: 95 - protein, 12 aa, Artificial Sequence
  N-terminal RuvC-like domain
DLGTNSIGSSVR

SEQ ID NO: 96 - protein, 12 aa, Artificial Sequence
  N-terminal RuvC-like domain
DIGTNSIGWAVI

SEQ ID NO: 97 - protein, 12 aa, Pasteurella multocida str. Pm70
DLGIASVGWAVV

SEQ ID NO: 98 - protein, 12 aa, Artificial Sequence
  N-terminal RuvC-like domain
DIGIASVGWAVL

SEQ ID NO: 99 - protein, 12 aa, Helicobacter mustelae 12198
DIGIASIGWAVI

SEQ ID NO: 100 - protein, 12 aa, Artificial Sequence
  N-terminal RuvC-like domain
DIGIASVGWAII

SEQ ID NO: 101 - protein, 12 aa, Clostridium cellulolyticum H10
DVGIASVGWAVI

SEQ ID NO: 102 - protein, 11 aa, Artificial Sequence
  N-terminal RuvC-like domain
DIGIASVGWAL

SEQ ID NO: 103 - protein, 12 aa, Neisseria meningitidis
DIGIASVGWAMV

SEQ ID NO: 104 - protein, 12 aa, Artificial Sequence
  N-terminal RuvC-like domain
DIGITSVGWAVI

SEQ ID NO: 105 - protein, 12 aa, Wolinella succinogenes DSM 1740
DLGISSLGWAIV

SEQ ID NO: 106 - protein, 12 aa, Azospirillum sp. B510
DLGTNSIGWGLL

SEQ ID NO: 107 - protein, 12 aa, Artificial Sequence
  N-terminal RuvC-like domain
DLGSTSLGWAIF

SEQ ID NO: 108 - protein, 12 aa, Campylobacter jejuni, NCTC 11168
DIGISSIGWAFS

SEQ ID NO: 109 - protein, 12 aa, Parvibaculum lavamentivorans DS-1
DIGTTSIGFSVI

SEQ ID NO: 110 - protein, 12 aa, Dinoroseobacter shibae DFL 12
DIGTSSIGWWLY

SEQ ID NO: 111 - protein, 12 aa, Nitrobacter hamburgensis X14
DLGSNSLGWFVT

SEQ ID NO: 112 - protein, 12 aa, Bradyrhizobium sp. BTAi1
DLGANSLGWFVV

SEQ ID NO: 113 - protein, 15 aa, Artificial Sequence
  N-terminal RuvC-like domain
DIGLRIGITSCGWSI

SEQ ID NO: 114 - protein, 12 aa, Artificial Sequence
  N-terminal RuvC-like domain
DMGAKYTGVFYA

SEQ ID NO: 115 - protein, 12 aa, Wolinella succinogenes DSM 1740
DLGGKNTGFFSF

SEQ ID NO: 116 - protein, 12 aa, Artificial Sequence
  N-terminal RuvC-like domain
DLGVKNTGVFSA

SEQ ID NO: 117 - protein, 12 aa, Artificial Sequence
  N-terminal RuvC-like domain
DLGAKFTGVALY

SEQ ID NO: 118 - protein, 12 aa, Legionella pneumophila str. Paris
DLGGKFTGVCLS

SEQ ID NO: 119 - protein, 12 aa, Artificial Sequence
  N-terminal RuvC-like domain
DLGGTYTGTFIT

SEQ ID NO: 120 - protein, 12 aa, S. thermophilus
DIGTNSVGWAVT

SEQ ID NO: 121 - protein, 12 aa, Eubacterium yurii
DVGTNSVGWAVT

SEQ ID NO: 122 - protein, 12 aa, Artificial Sequence
  N-terminal RuvC-like domain
DMGTNSVGWAVT

SEQ ID NO: 123 - protein, 12 aa, Solobacterium moorei F0204
DVGTSSVGWAVT

SEQ ID NO: 124 - protein, 27 aa, Treponema denticola
DIDHIYPQSKIKDDSISNRVLVCSSCN

SEQ ID NO: 125 - protein, 27 aa, Coprococcus catus GD-7
DIDHIYPQSKTMDDSLNNRVLVKKNYN

SEQ ID NO: 126 - protein, 27 aa, Peptoniphilus duerdenii
DQDHIYPKSKIYDDSLENRVLVKKNLN

SEQ ID NO: 127 - protein, 27 aa, Catenibacterium mitsuokai DSM 15897
QIDHIVPQSLVKDDSFDNRVLVVPSEN

SEQ ID NO: 128 - protein, 27 aa, S. mutans
DIDHIIPQAFIKDNSIDNRVLTSSKEN

SEQ ID NO: 129 - protein, 27 aa, S. thermophilus
DIDHIIPQAFLKDNSIDNKVLVSSASN

SEQ ID NO: 130 - protein, 27 aa, Oenococcus kitaharae DSM 17330
DIDHIIPQAYTKDNSLDNRVLVSNITN

SEQ ID NO: 131 - protein, 27 aa, L. inocua
DIDHIVPQSFITDNSIDNLVLTSSAGN

SEQ ID NO: 132 - protein, 27 aa, S. pyogenes
DVDHIVPQSFLKDDSIDNKVLTRSDKN

SEQ ID NO: 133 - protein, 27 aa, Acidaminococcus sp. D21
NIDHIYPQSMVKDDSLDNKVLVQSEIN

SEQ ID NO: 134 - protein, 27 aa, Lactobacillus rhamnosus GG
DIDHILPQSLIKDDSLDNRVLVNATIN

SEQ ID NO: 135 - protein, 27 aa, Artificial Sequence
  HNH-LIKE domain
DIDHILPQSFIKDDSLENRVLVKKAVN

SEQ ID NO: 136 - protein, 27 aa, Staphylococcus pseudintermedius ED99
EVDHIFPRSFIKDDSIDNKVLVIKKMN

SEQ ID NO: 137 - protein, 27 aa, Artificial Sequence
  HNH-LIKE domain
EVDHIIPRSYIKDDSFENKVLVYREEN

SEQ ID NO: 138 - protein, 27 aa, Bifidobacterium bifidum S17
DIDHIIPQAVTQNDSIDNRVLVARAEN

SEQ ID NO: 139 - protein, 27 aa, Mycoplasma gallisepticum str. F
EIDHIIPYSISFDDSSSNKLLVLAESN

SEQ ID NO: 140 - protein, 27 aa, Mycoplasma canis PG 14
EIDHIIPYSLCFDDSSANKVLVHKQSN

SEQ ID NO: 141 - protein, 27 aa, Ilyobacter polytropus DSM 2926
DIDHIIPYSRSMDDSYSNKVLVLSGEN

SEQ ID NO: 142 - protein, 27 aa, Artificial Sequence
  HNH-LIKE domain
DIDHIIPYSKSMDDSFNNKVLCLAEEN

SEQ ID NO: 143 - protein, 27 aa, Campylobacter jejuni
EIDHIYPYSRSFDDSYMNKVLVFTKQN

SEQ ID NO: 144 - protein, 27 aa, Clostridium cellulolyticum H10
QIDHIYPYSRSMDDSYMNKVLVLTDEN

SEQ ID NO: 145 - protein, 27 aa, Artificial Sequence
  HNH-LIKE domain
EIDHIIPFSRSFDDSLSNKILVLGSEN

SEQ ID NO: 146 - protein, 27 aa, N. meningitides
EIDHALPFSRTWDDSFNNKVLVLGSEN

SEQ ID NO: 147 - protein, 27 aa, Pasteurella multocida str. Pm70
EIDHALPFSRTWDDSFNNKVLVLASEN

SEQ ID NO: 148 - protein, 27 aa, Enterococcus faecalis TX0012
EIDHIIPISISLDDSINNKVLVLSKAN

SEQ ID NO: 149 - protein, 27 aa, Eubacterium dolichum DSM 3991
EVDHIIPISISLDDSITNKVLVTHREN

SEQ ID NO: 150 - protein, 27 aa, Artificial Sequence
  HNH-LIKE domain
QVDHALPYSRSYDDSKNNKVLVLTHEN

SEQ ID NO: 151 - protein, 27 aa, Streptococcus thermophilus LMD-9
EVDHILPLSITFDDSLANKVLVYATAN

SEQ ID NO: 152 - protein, 27 aa, Eubacterium rectale
EIDHIIPRSISFDDARSNKVLVYRSEN

SEQ ID NO: 153 - protein, 27 aa, Staphylococcus lugdunensis M23590
EVDHIIPRSVSFDNSYHNKVLVKQSEN

SEQ ID NO: 154 - protein, 27 aa, Artificial Sequence
  HNH-LIKE domain
DIDHILPYSITFDDSFRNKVLVTSQEN

SEQ ID NO: 155 - protein, 27 aa, Wolinella succinogenes DSM 1740
EIDHILPRSRSADDSFANKVLCLARAN

SEQ ID NO: 156 - protein, 27 aa, Cand. Puniceispirillum marinum
EIEHLLPFSLTLDDSMANKTVCFRQAN

SEQ ID NO: 157 - protein, 27 aa, Azospirillum sp. B510
DIDHILPFSVSLDDSAANKVVCLREAN

SEQ ID NO: 158 - protein, 27 aa, Bradyrhizobium sp. BTAi1
DIDHLIPFSISWDDSAANKVVCMRYAN

SEQ ID NO: 159 - protein, 27 aa, Nitrobacter hamburgensis X14
DIDHILPVAMTLDDSPANKIICMRYAN

SEQ ID NO: 160 - protein, 27 aa, Artificial Sequence
  HNH-LIKE domain
DVDHILPYSRTLDDSFPNRTLCLREAN

SEQ ID NO: 161 - protein, 27 aa, Artificial Sequence
  HNH-LIKE domain
EIEHILPFSRTLDDSLNNRTVAMRRAN

SEQ ID NO: 162 - protein, 27 aa, Lactobacillus coryniformis KCTC 3535
EVDHIIPYSISWDDSYTNKVLTSAKCN

SEQ ID NO: 163 - protein, 27 aa, Artificial Sequence
  HNH-LIKE domain
QVDHILPWSRFGDDSYLNKTLCTARSN

SEQ ID NO: 164 - protein, 27 aa, Ralstonia syzygii R24
QVDHILPFSKTLDDSFANKVLAQHDAN

SEQ ID NO: 165 - protein, 27 aa, Helicobacter mustelae 12198
QIDHAFPLSRSLDDSQSNKVLCLTSSN

SEQ ID NO: 166 - protein, 27 aa, Mycoplasma mobile 163K
DIDHIVPRSISFDDSFSNLVIVNKLDN

SEQ ID NO: 167 - protein, 27 aa, Mycoplasma ovipneumoniae SC01
EIEHIIPYSMSYDNSQANKILTEKAEN

SEQ ID NO: 168 - protein, 27 aa, Mycoplasma synoviae 53
EIDHVIPYSKSADDSWFNKLLVKKSTN

SEQ ID NO: 169 - protein, 27 aa, Aminomonas paucivorans DSM 12260
EMDHILPYSRSLDNGWHNRVLVHGKDN

SEQ ID NO: 170 - protein, 27 aa, Ruminococcus albus 8
EVDHIVPYSLILDNTINNKALVYAEEN

SEQ ID NO: 171 - protein, 27 aa, Artificial Sequence
  HNH-LIKE domain
EIEHVIPQSLYFDDSFSNKVICEAEVN

SEQ ID NO: 172 - protein, 27 aa, Bacteroides fragilis, NCTC 9343
DIEHIIPQARLFDDSFSNKTLEARSVN

SEQ ID NO: 173 - protein, 27 aa, Artificial Sequence
  HNH-LIKE domain
EIEHIVPKARVFDDSFSNKTLTFHRIN

SEQ ID NO: 174 - protein, 28 aa, Finegoldia magna
DKDHIIPQSMKKDDSIINNLVLVNKNAN

SEQ ID NO: 175 - protein, 27 aa, Parvibaculum lavamentivorans DS-1
EVEHIWPRSRSFDNSPRNKTLCRKDVN

SEQ ID NO: 176 - protein, 27 aa, Artificial Sequence
  HNH-LIKE domain
IVNHIIPYNRSFDDTYHNRVLTLTETK

SEQ ID NO: 177 - protein, 27 aa, Artificial Sequence
  HNH-LIKE domain
DMEHTIPKSISFDNSDQNLTLCESYYN

SEQ ID NO: 178 - protein, 27 aa, Artificial Sequence
  HNH-LIKE domain
DIEHTIPRSAGGDSTKMNLTLCSSRFN

SEQ ID NO: 179 - protein, 27 aa, Artificial Sequence
  HNH-LIKE domain
DIEHTIPRSISQDNSQMNKTLCSLKFN

SEQ ID NO: 180 - protein, 27 aa, Rhodospirillum rubrum
DIDHVIPLARGGRDSLDNMVLCQSDAN

SEQ ID NO: 181 - protein, 27 aa, Elusimicrobium minutum Pei191
DIEHLFPIAESEDNGRNNLVISHSACN

SEQ ID NO: 182 - protein, 27 aa, Sphaerochaeta globus str. Buddy
DVDHIFPRDDTADNSYGNKVVAHRQCN

SEQ ID NO: 183 - protein, 27 aa, Nitratifractor salsuginis DSM 16511
DIEHIVPQSLGGLSTDYNTIVTLKSVN

SEQ ID NO: 184 - protein, 27 aa, Acidothermus cellulolyticus 11B
ELDHIVPRTDGGSNRHENLAITCGACN

SEQ ID NO: 185 - protein, 28 aa, Bifidobacterium longum DJO10A
EMDHIVPRKGVGSTNTRTNFAAVCAECN

SEQ ID NO: 186 - protein, 28 aa, Artificial Sequence
  HNH-LIKE domain
EMDHIVPRKGVGSTNTRVNLAAACAACN

SEQ ID NO: 187 - protein, 28 aa, Artificial Sequence
  HNH-LIKE domain
EMDHIVPRAGQGSTNTRENLVAVCHRCN

SEQ ID NO: 188 - protein, 33 aa, Artificial Sequence
  HNH-LIKE domain
EIDHILPRSLIKDARGIVFNAEPNLIYASSRGN

SEQ ID NO: 189 - protein, 33 aa, Artificial Sequence
  HNH-LIKE domain
EIDHIIPRSLTGRTKKTVFNSEANLIYCSSKGN

SEQ ID NO: 190 - protein, 33 aa, Artificial Sequence
  HNH-LIKE domain
EIDHIIPRSLTLKKSESIYNSEVNLIFVSAQGN

SEQ ID NO: 191 - protein, 33 aa, Legionella pneumophila str. Paris
EIDHIYPRSLSKKHFGVIFNSEVNLIYCSSQGN

SEQ ID NO: 192 - protein, 33 aa, Wolinella succinogenes DSM 1740
EIDHILPRSHTLKIYGTVFNPEGNLIYVHQKCN

SEQ ID NO: 193 - protein, 30 aa, Artificial Sequence
  HNH-LIKE domain
ELDHIIPRSHKKYGTLNDEANLICVTRGDN

SEQ ID NO: 194 - protein, 27 aa, Akkermansia muciniphila
ELEHIVPHSFRQSNALSSLVLTWPGVN

SEQ ID NO: 195 - protein, 27 aa, Solobacterium moorei F0204
DIDHIYPRSKIKDDSITNRVLVEKDIN

SEQ ID NO: 196 - protein, 28 aa, Veillonella atypica ACS-134-V-Col7a
YDIDHIYPRSLTKDDSFDNLVLCERTAN

SEQ ID NO: 197 - protein, 28 aa, Fusobacterium nucleatum
DIDHIYPRSKVIKDDSFDNLVLVLKNEN

SEQ ID NO: 198 - protein, 27 aa, Filifactor alocis
DRDHIYPQSKIKDDSIDNLVLVNKTYN

SEQ ID NO: 199 - DNA, 5 bp, S. thermophilus
  misc_feature (1)..(1): n is a, c, g, or t
  misc_feature (4)..(4): n is a, c, g, or t
nggng

SEQ ID NO: 200 - DNA, 7 bp, S. thermophilus
  misc_feature (1)..(2): n is a, c, g, or t
nnagaaw

SEQ ID NO: 201 - DNA, 4 bp, S. mutans
  misc_feature (1)..(1): n is a, c, g, or t
naar

SEQ ID NO: 202 - DNA, 5 bp, S. aureus
  misc_feature (1)..(2): n is a, c, g, or t
nngrr

SEQ ID NO: 203 - DNA, 6 bp, S. aureus
  misc_feature (1)..(2): n is a, c, g, or t
  misc_feature (6)..(6): n is a, c, g, or t
nngrrn

SEQ ID NO: 204 - DNA, 6 bp, Artificial Sequence
  Synthetic
  misc_feature (1)..(2): n is a, c, g, or t
nngrrt

SEQ ID NO: 205 - DNA, 6 bp, Artificial Sequence
  Synthetic
  misc_feature (1)..(2): n is a, c, g, or t
nngrrv

SEQ ID NO: 206-248 - skipped (43 entries)

SEQ ID NO: 249 - RNA, 20 nt, Artificial Sequence
  Synthetic:  gRNA 11
cacguucaccuugccccaca

SEQ ID NO: 250 - RNA, 20 nt, Artificial Sequence
  Synthetic:  gRNA 32
cauggugcaucugacuccug

SEQ ID NO: 251 - RNA, 20 nt, Artificial Sequence
  Synthetic:  gRNA 8
guaacggcagacuucuccuc

SEQ ID NO: 252 - RNA, 20 nt, Artificial Sequence
  Synthetic:  gRNA 15
aaggugaacguggaugaagu

SEQ ID NO: 253 - RNA, 20 nt, Artificial Sequence
  Synthetic:  gRNA 19
ccuguggggcaaggugaacg

SEQ ID NO: 254 - RNA, 20 nt, Artificial Sequence
  Synthetic:  gRNA 21
ugaaguugguggugaggccc

SEQ ID NO: 255 - protein, 236 aa, Artificial Sequence
  Synthetic:  Trex2 protein
MSEAPRAETFVFLDLEATGLPSVEPEIAELSLFAVHRSSLENPEHDESGALVLPRVLDKLTLCMCPERPFTAKASEITGLSSEGLARCRKAGFDGAVVRTLQAFLSRQAGPICLVAHNGFDYDFPLLCAELRRLGARLPRDTVCLDTLPALRGLDRAHSHGTRARGRQGYSLGSLFHRYFRAEPSAAHSAEGDVHTLLLIFLHRAAELLAWADEQARGWAHIEPMYLPPDDPSLEA

SEQ ID NO: 256 - DNA, 711 bp, Artificial Sequence
  Synthetic:  Trex2 n.a.
atgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 257 - protein, 1053 aa, Staphylococcus haemolyticus; identical to SEQ ID NO: 6
  misc_feature (1)..(1053): type II CRISPR RNA-guided endonuclease Cas9

SEQ ID NO: 258 - protein, 1368 aa, Streptococcus pyogenes [sequence omitted]

SEQ ID NO: 259 - protein, 984 aa, Campylobacter jejuni
  misc_feature (1)..(984): type II CRISPR RNA-guided endonuclease Cas9
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 260 - protein, 1436 aa, Bacteroides fragilis
  misc_feature (1)..(1436): type II CRISPR RNA-guided endonuclease Cas9
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 261 - protein, 1420 aa, Bifidobacterium bifidum
  misc_feature (1)..(1420): type II CRISPR RNA-guided endonuclease Cas9
MSRKNYVDDYAISLDIGNASVGWSAFTPNYRLVRAKGHELIGVRLFDPADTAESRRMARTTRRRYSRRRWRLRLLDALFDQALSEIDPSFLARRKYSWVHPDDENNADCWYGSVLFDSNEQDKRFYEKYPTIYHLRKALMEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLTFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 262 - protein, 1397 aa, Veillonella atypica
  misc_feature (1)..(1397): type II CRISPR RNA-guided endonuclease Cas9
METQTSNQLITSHLKDYPKQDYFVGLDIGTNSVGWAVTNTSYELLKFHSHKMWGSRLFEEGESAVTRRGFRSMRRRLERRKLRLKLLEELFADAMAQVDSTFFIRLHESKYHYEDKTTGHSSKHILFIDEDYTDQDYFTEYPTIYHLRKDLMENGTDDIRKLFLAVHHILKYRGNFLYEGATFNSNAFTFEDVLKQALVNITFNCFDTNSAISSISNILMESGKTKSDKAKAIERLVDTYTVFDEVNTPDKPQKEQVKEDKKTLKAFANLVLGLSANLIDLFGSVEDIDDDLKKLQIVGDTYDEKRDELAKVWGDEIHIIDDCKSVYDAIILMSIKEPGLTISQSKVKAFDKHKEDLVILKSLLKLDRNVYNEMFKSDKKGLHNYVHYIKQGRTEETSCSREDFYKYTKKIVEGLADSKDKEYILNEIELQTLLPLQRIKDNGVIPYQLHLEELKVILDKCGPKFPFLHTVSDGFSVTEKLIKMLEFRIPYYVGPLNTHHNIDNGGFSWAVRKQAGRVTPWNFEEKIDREKSAAAFIKNLTNKCTYLFGEDVLPKSSLLYSEFMLLNELNNVRIDGKALAQGVKQHLIDSIFKQDHKKMTKNRIELFLKDNNYITKKHKPEITGLDGEIKNDLTSYRDMVRILGNNFDVSMAEDIITDITIFGESKKMLRQTLRNKFGSQLNDETIKKLSKLRYRDWGRLSKKLLKGIDGCDKAGNGAPKTIIELMRNDSYNLMEILGDKFSFMECIEEENAKLAQGQVVNPHDIIDELALSPAVKRAVWQALRIVDEVAHIKKALPSRIFVEVARTNKSEKKKKDSRQKRLSDLYSAIKKDDVLQSGLQDKEFGALKSGLANYDDAALRSKKLYLYYTQMGRCAYTGNIIDLNQLNTDNYDIDHIYPRSLTKDDSFDNLVLCERTANAKKSDIYPIDNRIQTKQKPFWAFLKHQGLISERKYERLTRIAPLTADDLSGFIARQLVETNQSVKATTTLLRRLYPDIDVVFVKAENVSDFRHNNNFIKVRSLNHHHHAKDAYLNIVVGNVYHEKFTRNFRLFFKKNGANRTYNLAKMFNYDVICTNAQDGKAWDVKTSMNTVKKMMASNDVRVTRRLLEQSGALADATIYKASVAAKAKDGAYIGMKTKYSVFADVTKYGGMTKIKNAYSIIVQYTGKKGEEIKEIVPLPIYLINRNATDIELIDYVKSVIPKAKDISIKYRKLCINQLVKVNGFYYYLGGKTNDKIYIDNAIELVVPHDIATYIKLLDKYDLLRKENKTLKASSITTSIYNINTSTVVSLNKVGIDVFDYFMSKLRTPLYMKMKGNKVDELSSTGRSKFIKMTLEEQSIYLLEVLNLLTNSKTTFDVKPLGITGSRSTIGVKIHNLDEFKIINESITGLYSNEVTIV

SEQ ID NO: 263 - protein, 1363 aa, Lactobacillus rhamnosus
  misc_feature (1)..(1363): type II CRISPR RNA-guided endonuclease Cas9
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 264 - protein, 1365 aa, Filifactor alocis
  misc_feature (1)..(1365): type II CRISPR RNA-guided endonuclease Cas9
MTKEYYLGLDVGTNSVGWAVTDSQYNLCKFKKKDMWGIRLFESANTAKDRRLQRGNRRRLERKKQRIDLLQEIFSPEICKIDPTFFIRLNESRLHLEDKSNDFKYPLFIEKDYSDIEYYKEFPTIFHLRKHLIESEEKQDIRLIYLALHNIIKTRGHFLIDGDLQSAKQLRPILDTFLLSLQEEQNLSVSLSENQKDEYEEILKNRSIAKSEKVKKLKNLFEISDELEKEEKKAQSAVIENFCKFIVGNKGDVCKFLRVSKEELEIDSFSFSEGKYEDDIVKNLEEKVPEKVYLFEQMKAMYDWNILVDILETEEYISFAKVKQYEKHKTNLRLLRDIILKYCTKDEYNRMFNDEKEAGSYTAYVGKLKKNNKKYWIEKKRNPEEFYKSLGKLLDKIEPLKEDLEVLTMMIEECKNHTLLPIQKNKDNGVIPHQVHEVELKKILENAKKYYSFLTETDKDGYSVVQKIESIFRFRIPYYVGPLSTRHQEKGSNVWMVRKPGREDRIYPWNMEEIIDFEKSNENFITRMTNKCTYLIGEDVLPKHSLLYSKYMVLNELNNVKVRGKKLPTSLKQKVFEDLFENKSKVTGKNLLEYLQIQDKDIQIDDLSGFDKDFKTSLKSYLDFKKQIFGEEIEKESIQNMIEDIIKWITIYGNDKEMLKRVIRANYSNQLTEEQMKKITGFQYSGWGNFSKMFLKGISGSDVSTGETFDIITAMWETDNNLMQILSKKFTFMDNVEDFNSGKVGKIDKITYDSTVKEMFLSPENKRAVWQTIQVAEEIKKVMGCEPKKIFIEMARGGEKVKKRTKSRKAQLLELYAACEEDCRELIKEIEDRDERDFNSMKLFLYYTQFGKCMYSGDDIDINELIRGNSKWDRDHIYPQSKIKDDSIDNLVLVNKTYNAKKSNELLSEDIQKKMHSFWLSLLNKKLITKSKYDRLTRKGDFTDEELSGFIARQLVETRQSTKAIADIFKQIYSSEVVYVKSSLVSDFRKKPLNYLKSRRVNDYHHAKDAYLNIVVGNVYNKKFTSNPIQWMKKNRDTNYSLNKVFEHDVVINGEVIWEKCTYHEDTNTYDGGTLDRIRKIVERDNILYTEYAYCEKGELFNATIQNKNGNSTVSLKKGLDVKKYGGYFSANTSYFSLIEFEDKKGDRARHIIGVPIYIANMLEHSPSAFLEYCEQKGYQNVRILVEKIKKNSLLIINGYPLRIRGENEVDTSFKRAIQLKLDQKNYELVRNIEKFLEKYVEKKGNYPIDENRDHITHEKMNQLYEVLLSKMKKFNKKGMADPSDRIEKSKPKFIKLEDLIDKINVINKMLNLLRCDNDTKADLSLIELPKNAGSFVVKKNTIGKSKIILVNQSVTGLYENRREL

SEQ ID NO: 265 - protein, 1389 aa, Oenococcus kitaharae
  misc_feature (1)..(1389): type II CRISPR RNA-guided endonuclease Cas9
MARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 266 - protein, 1323 aa, Fructobacillus fructosus
  misc_feature (1)..(1323): type II CRISPR RNA-guided endonuclease Cas9
MVYDVGLDIGTGSVGWVALDENGKLARAKGKNLVGVRLFDTAQTAADRRGFRTTRRRLSRRKWRLRLLDELFSAEINEIDSSFFQRLKYSYVHPKDEENKAHYYGGYLFPTEEETKKFHRSYPTIYHLRQELMAQPNKRFDIREIYLAIHHLVKYRGHFLSSQEKITIGSTYNPEDLANAIEVYADEKGLSWELNNPEQLTEIISGEAGYGLNKSMKADEALKLFEFDNNQDKVAIKTLLAGLTGNQIDFAKLFGKDISDKDEAKLWKLKLDDEALEEKSQTILSQLTDEEIELFHAVVQAYDGFVLIGLLNGADSVSAAMVQLYDQHREDRKLLKSLAQKAGLKHKRFSEIYEQLALATDEATIKNGISTARELVEESNLSKEVKEDTLRRLDENEFLPKQRTKANSVIPHQLHLAELQKILQNQGQYYPFLLDTFEKEDGQDNKIEELLRFRIPYYVGPLVTKKDVEHAGGDADNHWVERNEGFEKSRVTPWNFDKVFNRDKAARDFIERLTGNDTYLIGEKTLPQNSLRYQLFTVLNELNNVRVNGKKFDSKTKADLINDLFKARKTVSLSALKDYLKAQGKGDVTITGLADESKFNSSLSSYNDLKKTFDAEYLENEDNQETLEKIIEIQTVFEDSKIASRELSKLPLDDDQVKKLSQTHYTGWGRLSEKLLDSKIIDERGQKVSILDKLKSTSQNFMSIINNDKYGVQAWITEQNTGSSKLTFDEKVNELTTSPANKRGIKQSFAVLNDIKKAMKEEPRRVYLEFAREDQTSVRSVPRYNQLKEKYQSKSLSEEAKVLKKTLDGNKNKMSDDRYFLYFQQQGKDMYTGRPINFERLSQDYDIDHIIPQAFTKDDSLDNRVLVSRPENARKSDSFAYTDEVQKQDGSLWTSLLKSGFINRKKYERLTKAGKYLDGQKTGFIARQLVETRQIIKNVASLIEGEYENSKAVAIRSEITADMRLLVGIKKHREINSFHHAFDALLITAAGQYMQNRYPDRDSTNVYNEFDRYTNDYLKNLRQLSSRDEVRRLKSFGFVVGTMRKGNEDWSEENTSYLRKVMMFKNILTTKKTEKDRGPLNKETIFSPKSGKKLIPLNSKRSDTALYGGYSNVYSAYMTLVRANGKNLLIKIPISIANQIEVGNLKINDYIVNNPAIKKFEKILISKLPLGQLVNEDGNLIYLASNEYRHNAKQLWLSTTDADKIASISENSSDEELLEAYDILTSENVKNRFPFFKKDIDKLSQVRDEFLDSDKRIAVIQTILRGLQIDAAYQAPVKIISKKVSDWHKLQQSGGIKLSDNSEMIYQSATGIFETRVKISDLL

SEQ ID NO: 267 - protein, 1329 aa, Catenibacterium mitsuokai
  misc_feature (1)..(1329): type II CRISPR RNA-guided endonuclease Cas9
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 268 - protein, 1348 aa, Finegoldia magna
  misc_feature (1)..(1348): type II CRISPR RNA-guided endonuclease Cas9
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 269 - protein, 1384 aa, Coriobacterium glomerans
  misc_feature (1)..(1384): type II CRISPR RNA-guided endonuclease Cas9
MKLRGIEDDYSIGLDMGTSSVGWAVTDERGTLAHFKRKPTWGSRLFREAQTAAVARMPRGQRRRYVRRRWRLDLLQKLFEQQMEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKVDDFNRAFFAENAQALGVNELPGSPAVRRSLNQSIRIVDEIASIAGKAPANIFIEVTRDEDPKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETGQMVKLVRSLLEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRMPFEDHGVFWDATIYSPRAKKTAALPLKQGLNPSRYGSFSREQFAYFFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 270 - protein, 1391 aa, Eubacterium yurii
  misc_feature (1)..(1391): type II CRISPR RNA-guided endonuclease Cas9
MENKQYYIGLDVGTNSVGWAVTDTSYNLLRAKGKDMWGARLFEKANTAAERRTKRTSRRRSEREKARKAMLKELFADEINRVDPSFFIRLEESKFFLDDRSENNRQRYTLFNDATFTDKDYYEKYKTIFHLRSALINSDEKFDVRLVFLAILNLFSHRGHFLNASLKGDGDIQGMDVFYNDLVESCEYFEIELPRITNIDNFEKILSQKGKSRTKILEELSEELSISKKDKSKYNLIKLISGLEASVVELYNIEDIQDENKKIKIGFRESDYEESSLKVKEIIGDEYFDLVERAKSVHDMGLLSNIIGNSKYLCEARVEAYENHHKDLLKIKELLKKYDKKAYNDMFRKMTDKNYSAYVGSVNSNIAKERRSVDKRKIEDLYKYIEDTALKNIPDDNKDKIEILEKIKLGEFLKKQLTASNGVIPNQLQSRELRAILKKAENYLPFLKEKGEKNLTVSEMIIQLFEFQIPYYVGPLDKNPKKDNKANSWAKIKQGGRILPWNFEDKVDVKGSRKEFIEKMVRKCTYISDEHTLPKQSLLYEKFMVLNEINNIKIDGEKISVEAKQKIYNDLFVKGKKVSQKDIKKELISLNIMDKDSVLSGTDTVCNAYLSSIGKFTGVFKEEINKQSIVDMIEDIIFLKTVYGDEKRFVKEEIVEKYGDEIDKDKIKRILGFKFSNWGNLSKSFLELEGADVGTGEVRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYNGIKEDSKQWVKELDSKDESYFRSKKMYLYYLQKGRCMYSGEVIELDKLMDDNLYDIDHIYPRSFVKDDSLDNLVLVKKEINNRKQNDPITPQIQASCQGFWKILHDQGFMSNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPVYKYHMDRFFERDVKSKSEVAWIGQSEGNSGTIVIVKKTMAKNSPLITKKVEEGHGSITKETIVGVKEIKFGRNKVEKADKTPKKPNLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 271 - protein, 1364 aa, Peptoniphilus duerdenii
  misc_feature (1)..(1364): type II CRISPR RNA-guided endonuclease Cas9
MKNLKEYYIGLDIGTASVGWAVTDESYNIPKFNGKKMWGVRLFDDAKTAEERRTQRGSRRRLNRRKERINLLQDLFATEISKVDPNFFLRLDNSDLYREDKDEKLKSKYTLFNDKDFKDRDYHKKYPTIHHLIMDLIEDEGKKDIRLLYLACHYLLKNRGHFIFEGQKFDTKNSFDKSINDLKIHLRDEYNIDLEFNNEDLIEIITDTTLNKTNKKKELKNIVGDTKFLKAISAIMIGSSQKLVDLFEDGEFEETTVKSVDFSTTAFDDKYSEYEEALGDTISLLNILKSIYDSSILENLLKDADKSKDGNKYISKAFVKKFNKHGKDLKTLKRIIKKYLPSEYANIFRNKSINDNYVAYTKSNITSNKRTKASKFTKQEDFYKFIKKHLDTIKETKLNSSENEDLKLIDEMLTDIEFKTFIPKLKSSDNGVIPYQLKLMELKKILDNQSKYYDFLNESDEYGTVKDKVESIMEFRIPYYVGPLNPDSKYAWIKRENTKITPWNFKDIVDLDSSREEFIDRLIGRCTYLKEEKVLPKASLIYNEFMVLNELNNLKLNEFLITEEMKKAIFEELFKTKKKVTLKAVSNLLKKEFNLTGDILLSGTDGDFKQGLNSYIDFKNIIGDKVDRDDYRIKIEEIIKLIVLYEDDKTYLKKKIKSAYKNDFTDDEIKKIAALNYKDWGRLSKRFLTGIEGVDKTTGEKGSIIYFMREYNLNLMELMSGHYTFTEEVEKLNPVENRELCYEMVDELYLSPSVKRMLWQSLRVVDEIKRIIGKDPKKIFIEMARAKEAKNSRKESRKNKLLEFYKFGKKAFINEIGEERYNYLLNEINSEEESKFRWDNLYLYYTQLGRCMYSLEPIDLADLKSNNIYDQDHIYPKSKIYDDSLENRVLVKKNLNHEKGNQYPIPEKVLNKNAYGFWKILFDKGLIGQKKYTRLTRRTPFEERELAEFIERQIVETRQATKETANLLKNICQDSEIVYSKAENASRFRQEFDIIKCRTVNDLHHMHDAYLNIVVGNVYNTKFTKNPLNFIKDKDNVRSYNLENMFKYDVVRGSYTAWIADDSEGNVKAATIKKVKRELEGKNYRFTRMSYIGTGGLYDQNLMRKGKGQIPQKENTNKSNIEKYGGYNKASSAYFALIESDGKAGRERTLETIPIMVYNQEKYGNTEAVDKYLKDNLELQDPKILKDKIKINSLIKLDGFLYNIKGKTGDSLSIAGSVQLIVNKEEQKLIKKMDKFLVKKKDNKDIKVTSFDNIKEEELIKLYKTLSDKLNNGIYSNKRNNQAKNISEALDKFKEISIEEKIDVLNQIILLFQSYNNGCNLKSIGLSAKTGVVFIPKKLNYKECKLINQSITGLFENEVDLLNL

SEQ ID NO: 272 - protein, 1358 aa, Acidaminococcus
  misc_feature (1)..(1358): type II CRISPR RNA-guided endonuclease Cas9
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 273 - protein, 1356 aa, Lactobacillus farciminis
  misc_feature (1)..(1356): type II CRISPR RNA-guided endonuclease Cas9
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 274 - protein, 1421 aa, Streptococcus sanguinis
  misc_feature (1)..(1421): type II CRISPR RNA-guided endonuclease Cas9
MTKFNKNYSIGLDIGVSSVGYAVVTEDYRVPAFKFKVLGNTEKEKIKKNLIGSTTFVSAQPAKGTRVFRVNRRRIDRRNHRITYLRDIFQKEIEKVDKNFYRRLDESFRVLGDKSEDLQIKQPFFGDKELETAYHKKYPTIYHLRKHLADADKNSPVADIREVYMAISHILKYRGHFLTLDKINPNNINMQNSWIDFIESCQEVFDLEISDESKNIADIFKSSENRQEKVKKILPYFQQELLKKDKSIFKQLLQLLFGLKTKFKDCFELEEEPDLNFSKENYDENLENFLGSLEEDFSDVFAKLKVLRDTILLSGMLTYTGATHARFSATMVERYEEHRKDLQRFKFFIKQNLSEQDYLDIFGRKTQNGFDVDKETKGYVGYITNKMVLTNPQKQKTIQQNFYDYISGKITGIEGAEYFLNKISDGTFLRKLRTSDNGAIPNQIHAYELEKIIERQGKDYPFLLENKDKLLSILTFKIPYYVGPLAKGSNSRFAWIKRATSSDILDDNDEDTRNGKIRPWNYQKLINMDETRDAFITNLIGNDIILLNEKVLPKRSLIYEEVMLQNELTRVKYKDKYGKAHFFDSELRQNIINGLFKNNSKRVNAKSLIKYLSDNHKDLNAIEIVSGVEKGKSFNSTLKTYNDLKTIFSEELLDSEIYQKELEEIIKVITVFDDKKSIKNYLTKFFGHLEILDEEKINQLSKLRYSGWGRYSAKLLLDIRDEDTGFNLLQFLRNDEENRNLTKLISDNTLSFEPKIKDIQSKSTIEDDIFDEIKKLAGSPAIKRGILNSIKIVDELVQIIGYPPHNIVIEMARENMTTEEGQKKAKTRKTKLESALKNIENSLLENGKVPHSDEQLQSEKLYLYYLQNGKDMYTLDKTGSPAPLYLDQLDQYEVDHIIPYSFLPIDSIDNKVLTHRENNQQKLNNIPDKETVANMKPFWEKLYNAKLISQTKYQRLTTSERTPDGVLTESMKAGFIERQLVETRQIIKHVARILDNRFSDTKIITLKSQLITNFRNTFHIAKIRELNDYHHAHDAYLAVVVGQTLLKVYPKLAPELIYGHHAHFNRHEENKATLRKHLYSNIMRFFNNPDSKVSKDIWDCNRDLPIIKDVIYNSQINFVKRTMIKKGAFYNQNPVGKFNKQLAANNRYPLKTKALCLDTSIYGGYGPMNSALSIIIIAERFNEKKGKIETVKEFHDIFIIDYEKFNNNPFQFLNDTSENGFLKKNNINRVLGFYRIPKYSLMQKIDGTRMLFESKSNLHKATQFKLTKTQNELFFHMKRLLTKSNLMDLKSKSAIKESQNFILKHKEEFDNISNQLSAFSQKMLGNTTSLKNLIKGYNERKIKEIDIRDETIKYFYDNFIKMFSFVKSGAPKDINDFFDNKCTVARMRPKPDKKLLNATLIHQSITGLYETRIDLSKLGED

SEQ ID NO: 275 - protein, 1338 aa, Unknown
  Cas9 variant
MKQEYFLGLDMGTGSLGWAVTDSTYQVMRKHGKALWGTRLFESASTAEERRMFRTARRRLDRRNWRIQVLQEIFSEEISKVDPGFFLRMKESKYYPEDKRDAEGNCPELPYALFVDDNYTDKNYHKDYPTIYHLRKMLMETTEIPDIRLVYLVLHHMMKHRGHFLLSGDISQIKEFKSTFEQLIQNIQDEELEWHISLDDAAIQFVEHVLKDRNLTRSTKKSRLIKQLNAKSACEKAILNLLSGGTVKLSDIFNNKELDESERPKVSFADSGYDDYIGIVEAELAEQYYIIASAKAVYDWSVLVEILGNSVSISEAKIKVYQKHQADLKTLKKIVRQYMTKEDYKRVFVDTEEKLNNYSAYIGMTKKNGKKVDLKSKQCTQADFYDFLKKNVIKVIDHKEITQEIESEIEKENFLPKQVTKDNGVIPYQVHDYELKKILDNLGTRMPFIKENAEKIQQLFEFRIPYYVGPLNRVDDGKDGKFTWSVRKSDARIYPWNFTEVIDVEASAEKFIRRMTNKCTYLVGEDVLPKDSLVYSKFMVLNELNNLRLNGEKISVELKQRIYEELFCKYRKVTRKKLERYLVIEGIAKKGVEITGIDGDFKASLTAYHDFKERLTDVQLSQRAKEAIVLNVVLFGDDKKLLKQRLSKMYPNLTTGQLKGICSLSYQGWGRLSKTFLEEITVPAPGTGEVWNIMTALWQTNDNLMQLLSRNYGFTNEVEEFNTLKKETDLSYKTVDELYVSPAVKRQIWQTLKVVKEIQKVMGNAPKRVFVEMAREKQEGKRSDSRKKQLVELYRACKNEERDWITELNAQSDQQLRSDKLFLYYIQKGRCMYSGETIQLDELWDNTKYDIDHIYPQSKTMDDSLNNRVLVKKNYNAIKSDTYPLSLDIQKKMMSFWKMLQQQGFITKEKYVRLVRSDELSADELAGFIERQIVETRQSTKAVATILKEALPDTEIVYVKAGNVSNFRQTYELLKVREMNDLHHAKDAYLNIVVGNAYFVKFTKNAAWFIRNNPGRSYNLKRMFEFDIERSGEIAWKAGNKGSIVTVKKVMQKNNILVTRKAYEVKGGLFDQQIMKKGKGQVPIKGNDERLADIEKYGGYNKAAGTYFMLVKSLDKKGKEIRTIEFVPLYLKNQIEINHESAIQYLAQERGLNSPEILLSKIKIDTLFKVDGFKMWLSGRTGNQLIFKGANQLILSHQEAAILKGVVKYVNRKNENKDAKLSERDGMTEEKLLQLYDTFLDKLSNTVYSIRLSAQIKTLTEKRAKFIGLSNEDQCIVLNEILHMFQCQSGSANLKLIGGPGSAGILVMNNNITACKQISVINQSPTGIYEKEIDLIKL

SEQ ID NO: 276 - skipped

SEQ ID NO: 277 - protein, 1368 aa, Unknown [sequence omitted]

SEQ ID NO: 278 - skipped

SEQ ID NO: 279 - protein, 1374 aa, Unknown
  Cas9 variant
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIEKLEKIICDSGKGLKDKEKEFKGIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKDKKEVVEKSRLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNENKEMNEVSYRDLIEESYVSPSLKRAILQTLKIYEEIKKITGRVPKKVFIEMARGGDESMKNKKIPARQEQLKKLYDSCGNDIANFSIDIKEMKNSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGELFNLNPIKKGETSNEIISIKPKLYDGKDNKLNEKYGYYTSLKAAYFIYVEHEKKNKKVKTFERITRIDSTLIKNEKNLIKYLVSQKKLLNPKIIKKIYKEQTLIIDSYPYTFTGVDSNKKVELKNKKQLYLEKKYEQILKNALKFVEDNQGETEENYKFIYLKKRNNNEKNETIDAVKERYNIEFNEMYDKFLEKLSSKDYKNYINNKLYTNFLNSKEKFKKLKLWEKSLILREFLKIFNKNTYGKYEIKDSQTKEKLFSFPEDTGRIRLGQSSLGNNKELLEESVTGLFVKKIKL

SEQ ID NO: 280 - protein, 1333 aa, Unknown
  Cas9 variant
MKNYTIGLDIGVASVGWVCIDENYKILNYNNRHAFGVHEFESAESAAGRRLKRGMRRRYNRRKKRLQLLQSLFDSYITDSGFFSKTDSQHFWKNNNEFENRSLTEVLSSLRISSRKYPTIYHLRSDLIESNKKMDLRLVYLALHNLVKYRGHFLQEGNWSEAASAEGMDDQLLELVTRYAELENLSPLDLSESQWKAAETLLLNRNLTKTDQSKELTAMFGKEYEPFCKLVAGLGVSLHQLFPSSEQALAYKETKTKVQLSNENVEEVMELLLEEESALLEAVQPFYQQVVLYELLKGETYVAKAKVSAFKQYQKDMASLKNLLDKTFGEKVYRSYFISDKNSQREYQKSHKVEVLCKLDQFNKEAKFAETFYKDLKKLLEDKSKTSIGTTEKDEMLRIIKAIDSNQFLQKQKGIQNAAIPHQNSLYEAEKILRNQQAHYPFITTEWIEKVKQILAFRIPYYIGPLVKDTTQSPFSWVERKGDAPITPWNFDEQIDKAASAEAFISRMRKTCTYLKGQEVLPKSSLTYERFEVLNELNGIQLRTTGAESDFRHRLSYEMKCWIIDNVFKQYKTVSTKRLLQELKKSPYADELYDEHTGEIKEVFGTQKENAFATSLSGYISMKSILGAVVDDNPAMTEELIYWIAVFEDREILHLKIQEKYPSITDVQRQKLALVKLPGWGRFSRLLIDGLPLDEQGQSVLDHMEQYSSVFMEVLKNKGFGLEKKIQKMNQHQVDGTKKIRYEDIEELAGSPALKRGIWRSVKIVEELVSIFGEPANIVLEVAREDGEKKRTKSRKDQWEELTKTTLKNDPDLKSFIGEIKSQGDQRFNEQRFWLYVTQQGKCLYTGKALDIQNLSMYEVDHILPQNFVKDDSLDNLALVMPEANQRKNQVGQNKMPLEIIEANQQYAMRTLWERLHELKLISSGKLGRLKKPSFDEVDKDKFIARQLVETRQIIKHVRDLLDERFSKSDIHLVKAGIVSKFRRFSEIPKIRDYNNKHHAMDALFAAALIQSILGKYGKNFLAFDLSKKDRQKQWRSVKGSNKEFFLFKNFGNLRLQSPVTGEEVSGVEYMKHVYFELPWQTTKMTQTGDGMFYKESIFSPKVKQAKYVSPKTEKFVHDEVKNHSICLVEFTFMKKEKEVQETKFIDLKVIEHHQFLKEPESQLAKFLAEKETNSPIIHARIIRTIPKYQKIWIEHFPYYFISTRELHNARQFEISYELMEKVKQLSERSSVEELKIVFGLLIDQMNDNYPIYTKSSIQDRVQKFVDTQLYDFKSFEIGFEELKKAVAANAQRSDTFGSRISKKPKPEEVAIGYESITGLKYRKPRSVVGTKR

SEQ ID NO: 281 - protein, 1395 aa, Unknown
  Cas9 variant
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 282 - protein, 1327 aa, Unknown
  Cas9 variant
MEGQMKNNGNNLQQGNYYLGLDVGTSSVGWAVTDTDYNVLKFRGKSMWGARLFDEASTAEERRTHRGNRRRLARRKYRLLLLEQLFEKEIRKIDDNFFVRLHESNLWADDKSKPSKFLLFNDTNFTDKDYLKKYPTIYHLRSDLIHNSTEHDIRLVFLALHHLIKYRGHFIYDNSANGDVKTLDEAVSDFEEYLNENDIEFNIENKKEFINVLSDKHLTKKEKKISLKKLYGDITDSENINISVLIEMLSGSSISLSNLFKDIEFDGKQNLSLDSDIEETLNDVVDILGDNIDLLIHAKEVYDIAVLTSSLGKHKYLCDAKVELFEKNKKDLMILKKYIKKNHPEDYKKIFSSPTEKKNYAAYSQTNSKNVCSQEEFCLFIKPYIRDMVKSENEDEVRIAKEVEDKSFLTKLKGTNNSVVPYQIHERELNQILKNIVAYLPFMNDEQEDISVVDKIKLIFKFKIPYYVGPLNTKSTRSWVYRSDEKIYPWNFSNVIDLDKTAHEFMNRLIGRCTYTNDPVLPMDSLLYSKYNVLNEINPIKVNGKAIPVEVKQAIYTDLFENSKKKVTRKSIYIYLLKNGYIEKEDIVSGIDIEIKSKLKSHHDFTQIVQENKCTPEEIERIIKGILVYSDDKSMLRRWLKNNIKGLSENDVKYLAKLNYKEWGRLSKTLLTDIYTINPEDGEACSILDIMWNTNATLMEILSNEKYQFKQNIENYKAENYDEKQNLHEELDDMYISPAARRSIWQALRIVDEIVDIKKSAPKKIFIEMAREKKSAMKKKRTESRKDTLLELYKSCKSQADGFYDEELFEKLSNESNSRLRRDQLYLYYTQMGRSMYTGKRIDFDKLINDKNTYDIDHIYPRSKIKDDSITNRVLVEKDINGEKTDIYPISEDIRQKMQPFWKILKEKGLINEEKYKRLTRNYELTDEELSSFVARQLVETQQSTKALATLLKKEYPSAKIVYSKAGNVSEFRNRKDKELPKFREINDLHHAKDAYLNIVVGNVYDTKFTEKFFNNIRNENYSLKRVFDFSVPGAWDAKGSTFNTIKKYMAKNNPIIAFAPYEVKGELFDQQIVPKGKGQFPIKQGKDIEKYGGYNKLSSAFLFAVEYKGKKARERSLETVYIKDVELYLQDPIKYCESVLGLKEPQIIKPKILMGSLFSINNKKLVVTGRSGKQYVCHHIYQLSINDEDSQYLKNIAKYLQEEPDGNIERQNILNITSVNNIKLFDVLCTKFNSNTYEIILNSLKNDVNEGREKFSELDILEQCNILLQLLKAFKCNRESSNLEKLNNKKQAGVIVIPHLFTKCSVFKVIHQSITGLFEKEMDLLK

SEQ ID NO: 283 - protein, 1334 aa, Unknown
  Cas9 variant
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 284 - protein, 1472 aa, Unknown
  Cas9 variant
MAKILGLDLGTNSIGWAVVERENIDFSLIDKGVRIFSEGVKSEKGIESSRAAERTGYRSARKIKYRRKLRKYETLKVLSLNRMCPLSIEEVEEWKKSGFKDYPLNPEFLKWLSTDEESNVNPYFFRDRASKHKVSLFELGRAFYHIAQRRGFLSNRLDQSAEGILEEHCPKIEAIVEDLISIDEISTNITDYFFETGILDSNEKNGYAKDLDEGDKKLVSLYKSLLAILKKNESDFENCKSEIIERLNKKDVLGKVKGKIKDISQAMLDGNYKTLGQYFYSLYSKEKIRNQYTSREEHYLSEFITICKVQGIDQINEEEKINEKKFDGLAKDLYKAIFFQRPLKSQKGLIGKCSFEKSKSRCAISHPDFEEYRMWTYLNTIKIGTQSDKKLRFLTQDEKLKLVPKFYRKNDFNFDVLAKELIEKGSSFGFYKSSKKNDFFYWFNYKPTDTVAACQVAASLKNAIGEDWKTKSFKYQTINSNKEQVSRTVDYKDLWHLLTVATSDVYLYEFAIDKLGLDEKNAKAFSKTKLKKDFASLSLSAINKILPYLKEGLLYSHAVFVANIENIVDENIWKDEKQRDYIKTQISEIIENYTLEKSRFEIINGLLKEYKSENEDGKRVYYSKEAEQSFENDLKKKLVLFYKSNEIENKEQQETIFNELLPIFIQQLKDYEFIKIQRLDQKVLIFLKGKNETGQIFCTEEKGTAEEKEKKIKNRLKKLYHPSDIEKFKKKIIKDEFGNEKIVLGSPLTPSIKNPMAMRALHQLRKVLNALILEGQIDEKTIIHIEMARELNDANKRKGIQDYQNDNKKFREDAIKEIKKLYFEDCKKEVEPTEDDILRYQLWMEQNRSEIYEEGKNISICDIIGSNPAYDIEHTIPRSRSQDNSQMNKTLCSQRFNREVKKQSMPIELNNHLEILPRIAHWKEEADNLTREIEIISRSIKAAATKEIKDKKIRRRHYLTLKRDYLQGKYDRFIWEEPKVGFKNSQIPDTGIITKYAQAYLKSYFKKVESVKGGMVAEFRKIWGIQESFIDENGMKHYKVKDRSKHTHHTIDAITIACMTKEKYDVLAHAWTLEDQQNKKEARSIIEASKPWKTFKEDLLKIEEEILVSHYTPDNVKKQAKKIVRVRGKKQFVAEVERDVNGKAVPKKAASGKTIYKLDGEGKKLPRLQQGDTIRGSLHQDSIYGAIKNPLNTDEIKYVIRKDLESIKGSDVESIVDEVVKEKIKEAIANKVLLLSSNAQQKNKLVGTVWMNEEKRIAINKVRIYANSVKNPLHIKEHSLLSKSKHVHKQKVYGQNDENYAMAIYELDGKRDFELINIFNLAKLIKQGQGFYPLHKKKEIKGKIVFVPIEKRNKRDVVLKRGQQVVFYDKEVENPKDISEIVDFKGRIYIIEGLSIQRIVRPSGKVDEYGVIMLRYFKEARKADDIKQDNFKPDGVFKLGENKPTRKMNHQFTAFVEGIDFKVLPSGKFEKI

SEQ ID NO: 285 - protein, 1688 aa, Unknown
  Cas9 variant
MEFKKVLGLDIGTNSIGCALLSLPKSIQDYGKGGRLEWLTSRVIPLDADYMKAFIDGKNGLPQVITPAGKRRQKRGSRRLKHRYKLRRSRLIRVFKTLNWLPEDFPLDNPKRIKETISTEGKFSFRISDYVPISDESYREFYREFGYPENEIEQVIEEINFRRKTKGKNKNPMIKLLPEDWVVYYLRKKALIKPTTKEELIRIIYLFNQRRGFKSSRKDLTETAILDYDEFAKRLAEKEKYSAENYETKFVSITKVKEVVELKTDGRKGKKRFKVILEDSRIEPYEIERKEKPDWEGKEYTFLVTQKLEKGKFKQNKPDLPKEEDWALCTTALDNRMGSKHPGEFFFDELLKAFKEKRGYKIRQYPVNRWRYKKELEFIWTKQCQLNPELNNLNINKEILRKLATVLYPSQSKFFGPKIKEFENSDVLHIISEDIIYYQRDLKSQKSLISECRYEKRKGIDGEIYGLKCIPKSSPLYQEFRIWQDIHNIKVIRKESEVNGKKKINIDETQLYINENIKEKLFELFNSKDSLSEKDILELISLNIINSGIKISKKEEETTHRINLFANRKELKGNETKSRYRKVFKKLGFDGEYILNHPSKLNRLWHSDYSNDYADKEKTEKSILSSLGWKNRNGKWEKSKNYDVFNLPLEVAKAIANLPPLKKEYGSYSALAIRKMLVVMRDGKYWQHPDQIAKDQENTSLMLFDKNLIQLTNNQRKVLNKYLLTLAEVQKRSTLIKQKLNEIEHNPYKLELVSDQDLEKQVLKSFLEKKNESDYLKGLKTYQAGYLIYGKHSEKDVPIVNSPDELGEYIRKKLPNNSLRNPIVEQVIRETIFIVRDVWKSFGIIDEIHIELGRELKNNSEERKKTSESQEKNFQEKERARKLLKELLNSSNFEHYDENGNKIFSSFTVNPNPDSPLDIEKFRIWKNQSGLTDEELNKKLKDEKIPTEIEVKKYILWLTQKCRSPYTGKIIPLSKLFDSNVYEIEHIIPRSKMKNDSTNNLVICELGVNKAKGDRLAANFISESNGKCKFGEVEYTLLKYGDYLQYCKDTFKYQKAKYKNLLATEPPEDFIERQINDTRYIGRKLAELLTPVVKDSKNIIFTIGSITSELKITWGLNGVWKDILRPRFKRLESIINKKLIFQDEDDPNKYHFDLSINPQLDKEGLKRLDHRHHALDATIIAATTREHVRYLNSLNAADNDEEKREYFLSLCNHKIRDFKLPWENFTSEVKSKLLSCVVSYKESKPILSDPFNKYLKWEYKNGKWQKVFAIQIKNDRWKAVRRSMFKEPIGTVWIKKIKEVSLKEAIKIQAIWEEVKNDPVRKKKEKYIYDDYAQKVIAKIVQELGLSSSMRKQDDEKLNKFINEAKVSAGVNKNLNTTNKTIYNLEGRFYEKIKVAEYVLYKAKRMPLNKKEYIEKLSLQKMFNDLPNFILEKSILDNYPEILKELESDNKYIIEPHKKNNPVNRLLLEHILEYHNNPKEAFSTEGLEKLNKKAINKIGKPIKYITRLDGDINEEEIFRGAVFETDKGSNVYFVMYENNQTKDREFLKPNPSISVLKAIEHKNKIDFFAPNRLGFSRIILSPGDLVYVPTNDQYVLIKDNSSNETIINWDDNEFISNRIYQVKKFTGNSCYFLKNDIASLILSYSASNGVGEFGSQNISEYSVDDPPIRIKDVCIKIRVDRLGNVRPL

SEQ ID NO: 286 - protein, 1415 aa, Unknown
  Cas9 variant
MKHILGLDLGTNSIGWALIERNIEEKYGKIIGMGSRIVPMGAELSKFEQGQAQTKNADRRTNRGARRLNKRYKQRRNKLIYILQKLDMLPSQIKLKEDFSDPNKIDKITILPISKKQEQLTAFDLVSLRVKALTEKVGLEDLGKIIYKYNQLRGYAGGSLEPEKEDIFDEEQSKDKKNKSFIAFSKIVFLGEPQEEIFKNKKLNRRAIIVETEEGNFEGSTFLENIKVGDSLELLINISASKSGDTITIKLPNKTNWRKKMENIENQLKEKSKEMGREFYISEFLLELLKENRWAKIRNNTILRARYESEFEAIWNEQVKHYPFLENLDKKTLIEIVSFIFPGEKESQKKYRELGLEKGLKYIIKNQVVFYQRELKDQSHLISDCRYEPNEKAIAKSHPVFQEYKVWEQINKLIVNTKIEAGTNRKGEKKYKYIDRPIPTALKEWIFEELQNKKEITFSAIFKKLKAEFDLREGIDFLNGMSPKDKLKGNETKLQLQKSLGELWDVLGLDSINRQIELWNILYNEKGNEYDLTSDRTSKVLEFINKYGNNIVDDNAEETAIRISKIKFARAYSSLSLKAVERILPLVRAGKYFNNDFSQQLQSKILKLLNENVEDPFAKAAQTYLDNNQSVLSEGGVGNSIATILVYDKHTAKEYSHDELYKSYKEINLLKQGDLRNPLVEQIINEALVLIRDIWKNYGIKPNEIRVELARDLKNSAKERATIHKRNKDNQTINNKIKETLVKNKKELSLANIEKVKLWEAQRHLSPYTGQPIPLSDLFDKEKYDVDHIIPISRYFDDSFTNKVISEKSVNQEKANRTAMEYFEVGSLKYSIFTKEQFIAHVNEYFSGVKRKNLLATSIPEDPVQRQIKDTQYIAIRVKEELNKIVGNENVKTTTGSITDYLRNHWGLTDKFKLLLKERYEALLESEKFLEAEYDNYKKDFDSRKKEYEEKEVLFEEQELTREEFIKEYKENYIRYKKNKLIIKGWSKRIDHRHHAIDALIVACTEPAHIKRLNDLNKVLQDWLVEHKSEFMPNFEGSNSELLEEILSLPENERTEIFTQIEKFRAIEMPWKGFPEQVEQKLKEIIISHKPKDKLLLQYNKAGDRQIKLRGQLHEGTLYGISQGKEAYRIPLTKFGGSKFATEKNIQKIVSPFLSGFIANHLKEYNNKKEEAFSAEGIMDLNNKLAQYRNEKGELKPHTPISTVKIYYKDPSKNKKKKDEEDLSLQKLDREKAFNEKLYVKTGDNYLFAVLEGEIKTKKTSQIKRLYDIISFFDATNFLKEEFRNAPDKKTFDKDLLFRQYFEERNKAKLLFTLKQGDFVYLPNENEEVILDKESPLYNQYWGDLKERGKNIYVVQKFSKKQIYFIKHTIADIIKKDVEFGSQNCYETVEGRSIKENCFKLEIDRLGNIVKVIKR

SEQ ID NO: 287 - protein, 1166 aa, Unknown
  Cas9 variant
MHVEIDFPHFSRGDSHLAMNKNEILRGSSVLYRLGLDLGSNSLGWFVTHLEKRGDRHEPVALGPGGVRIFPDGRDPQSGTSNAVDRRMARGARKRRDRFVERRKELIAALIKYNLLPDDARERRALEVLDPYALRKTALTDTLPAHHVGRALFHLNQRRGFQSNRKTDSKQSEDGAIKQAASRLATDKGNETLGVFFADMHLRKSYEDRQTAIRAELVRLGKDHLTGNARKKIWAKVRKRLFGDEVLPRADAPHGVRARATITGTKASYDYYPTRDMLRDEFNAIWAGQSAHHATITDEARTEIEHIIFYQRPLKPAIVGKCTLDPATRPFKEDPEGYRAPWSHPLAQRFRILSEARNLEIRDTGKGSRRLTKEQSDLVVAALLANREVKFDKLRTLLKLPAEARFNLESDRRAALDGDQTAARLSDKKGFNKAWRGFPPERQIAIVARLEETEDENELIAWLEKECALDGAAAARVANTTLPDGHCRLGLRAIKKIVPIMQDGLDEDGVAGAGYHIAAKRAGYDHAKLPTGEQLGRLPYYGQWLQDAVVGSGDARDQKEKQYGQFPNPTVHIGLGQLRRVVNDLIDKYGPPTEISIEFTRALKLSEQQKAERQREQRRNQDKNKARAEELAKFGRPANPRNLLKMRLWEELAHDPLDRKCVYTGEQISIERLLSDEVDIDHILPVAMTLDDSPANKIICMRYANRHKRKQTPSEAFGSSPTLQGHRYNWDDIAARATGLPRNKRWRFDANAREEFDKRGGFLARQLNETGWLARLAKQYLGAVTDPNQIWVVPGRLTSMLRGKWGLNGLLPSDNYAGVQDKAEEFLASTDDMEFSGVKNRADHRHHAIDGLVTALTDRSLLWKMANAYDEEHEKFVIEPPWPTMRDDLKAALEKMVVSHKPDHGIEGKLHEDSAYGFVKPLDATGLKEEEAGNLVYRKAIESLNENEVDRIRDIQLRTIVRDHVNVEKTKGVALADALRQLQAPSDDYPQFKHGLRHVRILKKEKGDYLVPIANRASGVAYKAYSAGENFCVEVFETAGGKWDGEAVRRFDANKKNAGPKIAHAPQWRDANEGAKLVMRIHKGDLIRLDHEGRARIMVVHRLDAAAGRFKLADHNETGNLDKRHATNNDIDPFRWLMASYNTLKKLAAVPVRVDELGRVWRVMPN

SEQ ID NO: 288 - protein, 1498 aa, Unknown
  Cas9 variant
METTLGIDLGTNSIGLALVDQEEHQILYSGVRIFPEGINKDTIGLGEKEESRNATRRAKRQMRRQYFRKKLRKAKLLELLIAYDMCPLKPEDVRRWKNWDKQQKSTVRQFPDTPAFREWLKQNPYELRKQAVTEDVTRPELGRILYQMIQRRGFLSSRKGKEEGKIFTGKDRMVGIDETRKNLQKQTLGAYLYDIAPKNGEKYRFRTERVRARYTLRDMYIREFEIIWQRQAGHLGLAHEQATRKKNIFLEGSATNVRNSKLITHLQAKYGRGHVLIEDTRITVTFQLPLKEVLGGKIEIEEEQLKFKSNESVLFWQRPLRSQKSLLSKCVFEGRNFYDPVHQKWIIAGPTPAPLSHPEFEEFRAYQFINNIIYGKNEHLTAIQREAVFELMCTESKDFNFEKIPKHLKLFEKFNFDDTTKVPACTTISQLRKLFPHPVWEEKREEIWHCFYFYDDNTLLFEKLQKDYALQTNDLEKIKKIRLSESYGNVSLKAIRRINPYLKKGYAYSTAVLLGGIRNSFGKRFEYFKEYEPEIEKAVCRILKEKNAEGEVIRKIKDYLVHNRFGFAKNDRAFQKLYHHSQAITTQAQKERLPETGNLRNPIVQQGLNELRRTVNKLLATCREKYGPSFKFDHIHVEMGRELRSSKTEREKQSRQIRENEKKNEAAKVKLAEYGLKAYRDNIQKYLLYKEIEEKGGTVCCPYTGKTLNISHTLGSDNSVQIEHIIPYSISLDDSLANKTLCDATFNREKGELTPYDFYQKDPSPEKWGASSWEEIEDRAFRLLPYAKAQRFIRRKPQESNEFISRQLNDTRYISKKAVEYLSAICSDVKAFPGQLTAELRHLWGLNNILQSAPDITFPLPVSATENHREYYVITNEQNEVIRLFPKQGETPRTEKGELLLTGEVERKVFRCKGMQEFQTDVSDGKYWRRIKLSSSVTWSPLFAPKPISADGQIVLKGRIEKGVFVCNQLKQKLKTGLPDGSYWISLPVISQTFKEGESVNNSKLTSQQVQLFGRVREGIFRCHNYQCPASGADGNFWCTLDTDTAQPAFTPIKNAPPGVGGGQIILTGDVDDKGIFHADDDLHYELPASLPKGKYYGIFTVESCDPTLIPIELSAPKTSKGENLIEGNIWVDEHTGEVRFDPKKNREDQRHHAIDAIVIALSSQSLFQRLSTYNARRENKKRGLDSTEHFPSPWPGFAQDVRQSVVPLLVSYKQNPKTLCKISKTLYKDGKKIHSCGNAVRGQLHKETVYGQRTAPGATEKSYHIRKDIRELKTSKHIGKVVDITIRQMLLKHLQENYHIDITQEFNIPSNAFFKEGVYRIFLPNKHGEPVPIKKIRMKEELGNAERLKDNINQYVNPRNNHHVMIYQDADGNLKEEIVSFWSVIERQNQGQPIYQLPREGRNIVSILQINDTFLIGLKEEEPEVYRNDLSTLSKHLYRVQKLSGMYYTFRHHLASTLNNEREEFRIQSLEAWKRANPVKVQIDEIGRITFLNGPLC

SEQ ID NO: 289 - protein, 1372 aa, Unknown
  Cas9 variant
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGSSSDKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 290 - protein, 1517 aa, Unknown
  Cas9 variant
MKKIVGLDLGTNSIGWALINAYINKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIIARLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSFNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICFPIKVDRLGNIIQVGSCILTN

SEQ ID NO: 291 - protein, 1101 aa, Unknown
  Cas9 variant
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 292 - protein, 1424 aa, Unknown
  Cas9 variant
MTQKVLGLDLGTNSIGSAVRNLDLSDDLQWQLEFFSSDIFRSSVNKESNGREYSLAAQRSAHRRSRGLNEVRRRRLWATLNLLIKHGFCPMSSESLMRWCTYDKRKGLFREYPIDDKDFNAWILLDFNGDGRPDYSSPYQLRRELVTRQFDFEQPIERYKLGRALYHIAQHRGFKSSKGETLSQQETNSKPSSTDEIPDVAGAMKASEEKLSKGLSTYMKEHNLLTVGAAFAQLEDEGVRVRNNNDYRAIRSQFQHEIETIFKFQQGLSVESELYERLISEKKNVGTIFYKRPLRSQRGNVGKCTLERSKPRCAIGHPLFEKFRAWTLINNIKVRMSVDTLDEQLPMKLRLDLYNECFLAFVRTEFKFEDIRKYLEKRLGIHFSYNDKTINYKDSTSVAGCPITARFRKMLGEEWESFRVEGQKERQAHSKNNISFHRVSYSIEDIWHFCYDAEEPEAVLAFAQETLRLERKKAEELVRIWSAMPQGYAMLSQKAIRNINKILMLGLKYSDAVILAKVPELVDVSDEELLSIAKDYYLVEAQVNYDKRINSIVNGLIAKYKSVSEEYRFADHNYEYLLDESDEKDIIRQIENSLGARRWSLMDANEQTDILQKVRDRYQDFFRSHERKFVESPKLGESFENYLTKKFPMVEREQWKKLYHPSQITIYRPVSVGKDRSVLRLGNPDIGAIKNPTVLRVLNTLRRRVNQLLDDGVISPDETRVVVETARELNDANRKWALDTYNRIRHDENEKIKKILEEFYPKRDGISTDDIDKARYVIDQREVDYFTGSKTYNKDIKKYKFWLEQGGQCMYTGRTINLSNLFDPNAFDIEHTIPESLSFDSSDMNLTLCDAHYNRFIKKNHIPTDMPNYDKAITIDGKEYPAITSQLQRWVERVERLNRNVEYWKGQARRAQNKDRKDQCMREMHLWKMELEYWKKKLERFTVTEVTDGFKNSQLVDTRVITRHAVLYLKSIFPHVDVQRGDVTAKFRKILGIQSVDEKKDRSLHSHHAIDATTLTIIPVSAKRDRMLELFAKIEEINKMLSFSGSEDRTGLIQELEGLKNKLQMEVKVCRIGHNVSEIGTFINDNIIVNHHIKNQALTPVRRRLRKKGYIVGGVDNPRWQTGDALRGEIHKASYYGAITQFAKDDEGKVLMKEGRPQVNPTIKFVIRRELKYKKSAADSGFASWDDLGKAIVDKELFALMKGQFPAETSFKDACEQGIYMIKKGKNGMPDIKLHHIRHVRCEAPQSGLKIKEQTYKSEKEYKRYFYAAVGDLYAMCCYTNGKIREFRIYSLYDVSCHRKSDIEDIPEFITDKKGNRLMLDYKLRTGDMILLYKDNPAELYDLDNVNLSRRLYKINRFESQSNLVLMTHHLSTSKERGRSLGKTVDYQNLPESIRSSVKSLNFLIMGENRDFVIKNGKIIFNHR

SEQ ID NO: 293 - protein, 1409 aa, Unknown
  Cas9 variant
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 294 - protein, 1146 aa, Unknown
  Cas9 variant
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRDAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKGGKYYFVPIYVADVLKRELPNRLATAHKPYSEWRVVDDSYQFKFSLYPNDAVMIKPSREVDITYKDRKEPVGCRIMYFVSANIASASISLRTHDNSGELEGLGIQGLEVFEKYVVGPLGDTHPVYKERRMPFRVERKMN

SEQ ID NO: 295 - protein, 1442 aa, Unknown
  Cas9 variant
MPVLSPLSPNAAQGRRRWSLALDIGEGSIGWAVAEVDAEGRVLQLTGTGVTLFPSAWSNENGTYVAHGAADRAVRGQQQRHDSRRRRLAGLARLCAPVLERSPEDLKDLTRTPPKADPRAIFFLRADAARRPLDGPELFRVLHHMAAHRGIRLAELQEVDPPPESDADDAAPAATEDEDGTRRAAADERAFRRLMAEHMHRHGTQPTCGEIMAGRLRETPAGAQPVTRARDGLRVGGGVAVPTRALIEQEFDAIRAIQAPRHPDLPWDSLRRLVLDQAPIAVPPATPCLFLEELRRRGETFQGRTITREAIDRGLTVDPLIQALRIRETVGNLRLHERITEPDGRQRYVPRAMPELGLSHGELTAPERDTLVRALMHDPDGLAAKDGRIPYTRLRKLIGYDNSPVCFAQERDTSGGGITVNPTDPLMARWIDGWVDLPLKARSLYVRDVVARGADSAALARLLAEGAHGVPPVAAAAVPAATAAILESDIMQPGRYSVCPWAAEAILDAWANAPTEGFYDVTRGLFGFAPGEIVLEDLRRARGALLAHLPRTMAAARTPNRAAQQRGPLPAYESVIPSQLITSLRRAHKGRAADWSAADPEERNPFLRTWTGNAATDHILNQVRKTANEVITKYGNRRGWDPLPSRITVELAREAKHGVIRRNEIAKENRENEGRRKKESAALDTFCQDNTVSWQAGGLPKERAALRLRLAQRQEFFCPYCAERPKLRATDLFSPAETEIDHVIERRMGGDGPDNLVLAHKDCNNAKGKKTPHEHAGDLLDSPALAALWQGWRKENADRLKGKGHKARTPREDKDFMDRVGWRFEEDARAKAEENQERRGRRMLHDTARATRLARLYLAAAVMPEDPAEIGAPPVETPPSPEDPTGYTAIYRTISRVQPVNGSVTHMLRQRLLQRDKNRDYQTHHAEDACLLLLAGPAVVQAFNTEAAQHGADAPDDRPVDLMPTSDAYHQQRRARALGRVPLATVDAALADIVMPESDRQDPETGRVHWRLTRAGRGLKRRIDDLTRNCVILSRPRRPSETGTPGALHNATHYGRREITVDGRTDTVVTQRMNARDLVALLDNAKIVPAARLDAAAPGDTILKEICTEIADRHDRVVDPEGTHARRWISARLAALVPAHAEAVARDIAELADLDALADADRTPEQEARRSALRQSPYLGRAISAKKADGRARAREQEILTRALLDPHWGPRGLRHLIMREARAPSLVRIRANKTDAFGRPVPDAAVWVKTDGNAVSQLWRLTSVVTDDGRRIPLPKPIEKRIEISNLEYARLNGLDEGAGVTGNNAPPRPLRQDIDRLTPLWRDHGTAPGGYLGTAVGELEDKARSALRGKAMRQTLTDAGITAEAGWRLDSEGAVCDLEVAKGDTVKKDGKTYKVGVITQGIFGMPVDAAGSAPRTPEDCEKFEEQYGIKPWKAKGIPLA

SEQ ID NO: 296 - protein, 1114 aa, Unknown
  Cas9 variant
MNYTEKEKLFMKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 297 - protein, 1314 aa, Unknown
  Cas9 variant
MLRLYCANNLVLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 298 - protein, 1197 aa, Unknown
  Cas9 variant
MLMSKHVLGLDLGVGSIGWCLIALDAQGDPAEILGMGSRVVPLNNATKAIEAFNAGAAFTASQERTARRTMRRGFARYQLRRYRLRRELEKVGMLPDAALIQLPLLELWELRERAATAGRRLTLPELGRVLCHINQKRGYRHVKSDAAAIVGDEGEKKKDSNSAYLAGIRANDEKLQAEHKTVGQYFAEQLRQNQSESPTGGISYRIKDQIFSRQCYIDEYDQIMAVQRVHYPDILTDEFIRMLRDEVIFMQRPLKSCKHLVSLCEFEKQERVMRVQQDDGKGGWQLVERRVKFGPKVAPKSSPLFQLCCIYEAVNNIRLTRPNGSPCDITPEERAKIVAHLQSSASLSFAALKKLLKEKALIADQLTSKSGLKGNSTRVALASALQPYPQYHHLLDMELETRMMTVQLTDEETGEVTEREVAVVTDSYVRKPLYRLWHILYSIEEREAMRRALITQLGMKEEDLDGGLLDQLYRLDFVKPGYGNKSAKFICKLLPQLQQGLGYSEACAAVGYRHSNSPTSEEITERTLLEKIPLLQRNELRQPLVEKILNQMINLVNALKAEYGIDEVRVELARELKMSREERERMARNNKDREERNKGVAAKIRECGLYPTKPRIQKYMLWKEAGRQCLYCGRSIEEEQCLREGGMEVEHIIPKSVLYDDSYGNKTCACRRCNKEKGNRTALEYIRAKGREAEYMKRINDLLKEKKISYSKHQRLRWLKEDIPSDFLERQLRLTQYISRQAMAILQQGIRRVSASEGGVTARLRSLWGYGKILHTLNLDRYDSMGETERVSREGEATEELHITNWSKRMDHRHHAIDALVVACTRQSYIQRLNRLSSEFGREDKKKEDQEAQEQQATETGRLSNLERWLTQRPHFSVRTVSDKVAEILISYRPGQRVVTRGRNIYRKKMADGREVSCVQRGVLVPRGELMEASFYGKILSQGRVRIVKRYPLHDLKGEVVDPHLRELITTYNQELKSREKGAPIPPLCLDKDKKQEVRSVRCYAKTLSLDKAIPMCFDEKGEPTAFVKSASNHHLALYRTPKGKLVESIVTFWDAVDRARYGIPLVITHPREVMEQVLQRGDIPEQVLSLLPPSDWVFVDSLQQDEMVVIGLSDEELQRALEAQNYRKISEHLYRVQKMSSSYYVFRYHLETSVADDKNTSGRIPKFHRVQSLKAYEERNIRKVRVDLLGRISLL

SEQ ID NO: 299 - protein, 1121 aa, Unknown
  Cas9 variant
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 300 - protein, 1152 aa, Unknown
  Cas9 variant
MNAEHGKEGLLIMEENFQYRIGLDIGITSVGWAVLQNNSQDEPVRITDLGVRIFDVAENPKNGDALAAPRRDARTTRRRLRRRRHRLERIKFLLQENGLIEMDSFMERYYKGNLPDVYQLRYEGLDRKLKDEELAQVLIHIAKHRGFRSTRKAETKEKEGGAVLKATTENQKIMQEKGYRTVGEMLYLDEAFHTECLWNEKGYVLTPRNRPDDYKHTILRSMLVEEVHAIFAAQRAHGNQKATEGLEEAYVEIMTSQRSFDMGPGLQPDGKPSPYAMEGFGDRVGKCTFEKDEYRAPKATYTAELFVALQKINHTKLIDEFGTGRFFSEEERKTIIGLLLSSKELKYGTIRKKLNIDPSLKFNSLNYSAKKEGETEEERVLDTEKAKFASMFWTYEYSKCLKDRTEEMPVGEKADLFDRIGEILTAYKNDDSRSSRLKELGLSGEEIDGLLDLSPAKYQRVSLKAMRKMQPYLEDGLIYDKACEAAGYDFRALNDGNKKHLLKGEEINAIVNDITNPVVKRSVSQTIKVINAIIQKYGSPQAVNIELAREMSKNFQDRTNLEKEMKKRQQENERAKQQIIELGKQNPTGQDILKYRLWNDQGGYCLYSGKKIPLEELFDGGYDIDHILPYSITFDDSYRNKVLVTAQENRQKGNRTPYEYFGADEKRWEDYEASVRLLVRDYKKQQKLLKKNFTEEERKEFKERNLNDTKYITRVVYNMIRQNLELEPFNHPEKKKQVWAVNGAVTSYLRKRWGLMQKDRSTDRHHAMDAVVIACCTDGMIHKISRYMQGRELAYSRNFKFPDEETGEILNRDNFTREQWDEKFGVKVPLPWNSFRDELDIRLLNEDPKNFLLTHADVQRELDYPGWMYGEEESPIEEGRYINYIRPLFVSRMPNHKVTGSAHDATIRSARDYETRGVVITKVPLTDLKLNKDNEIEGYYDKDSDRLLYQALVRQLLLHGNDGKKAFAEDFHKPKADGTEGPVVRKVKIEKKQTSGVMVRGGTGIAANGEMVRIDVFRENGKYYFVPVYTADVVRKVLPNRAATHTKPYSEWRVMDDANFVFSLYSRDLIHVKSKKDIKTNLVNGGLLLQKEIFAYYTGADIATASIAGFANDSNFKFRGLGIQSLEIFEKCQVDILGNISVVRHENRQEFH

SEQ ID NO: 301 - protein, 1082 aa, Unknown
  Cas9 variant
MRVLGLDAGIASLGWALIEIEESNRGELSQGTIIGAGTWMFDAPEEKTQAGAKLKSEQRRTFRGQRRVVRRRRQRMNEVRRILHSHGLLPSSDRDALKQPGLDPWRIRAEALDRLLGPVELAVALGHIARHRGFKSNSKGAKTNDPADDTSKMKRAVNETREKLARFGSAAKMLVEDESFVLRQTPTKNGASEIVRRFRNREGDYSRSLLRDDLAAEMRALFTAQARFQSAIATADLQTAFTKAAFFQRPLQDSEKLVGPCPFEVDEKRAPKRGYSFELFRFLSRLNHVTLRDGKQERTLTRDELALAAADFGAAAKVSFTALRKKLKLPETTVFVGVKADEESKLDVVARSGKAAEGTARLRSVIVDALGELAWGALLCSPEKLDKIAEVISFRSDIGRISEGLAQAGCNAPLVDALTAAASDGRFDPFTGAGHISSKAARNILSGLRQGMTYDKACCAADYDHTASRERGAFDVGGHGREALKRILQEERISRELVGSPTARKALIESIKQVKAIVERYGVPDRIHVELARDVGKSIEEREEITRGIEKRNRQKDKLRGLFEKEVGRPPQDGARGKEELLRFELWSEQMGRCLYTDDYISPSQLVATDDAVQVDHILPWSRFADDSYANKTLCMAKANQDKKGRTPYEWFKAEKTDTEWDAFIVRVEALADMKGFKKRNYKLRNAEEAAAKFRNRNLNDTRWACRLLAEALKQLYPKGEKDKDGKERRRVFSRPGALTDRLRRAWGLQWMKKSTKGDRIPDDRHHALDAIVIAATTESLLQRATREVQEIEDKGLHYDLVKNVTPPWPGFREQAVEAVEKVFVARAERRRARGKAHDATIRHIAVREGEQRVYERRKVAELKLADLDRVKDAERNARLIEKLRNWIEAGSPKDDPPLSPKGDPIFKVRLVTKSKVNIALDTGNPKRPGTVDRGEMARVDVFRKASKKGKYEYYLVPIYPHDIATMKTPPIRAVQAYKPEDEWPEMDSSYEFCWSLVPMTYLQVISSKGEIFEGYYRGMNRSVGAIQLSAHSNSSDVVQGIGARTLTEFKKFNVDRFGRKHEVERELRTWRGETWRGKAYI

SEQ ID NO: 302 - protein, 1156 aa, Unknown
  Cas9 variant
MGNYYLGLDVGIGSIGWAVINIEKKRIEDFNVRIFKSGEIQEKNRNSRASQQCRRSRGLRRLYRRKSHRKLRLKNYLSIIGLTTSEKIDYYYETADNNVIQLRNKGLSEKLTPEEIAACLIHICNNRGYKDFYEVNVEDIEDPDERNEYKEEHDSIVLISNLMNEGGYCTPAEMICNCREFDEPNSVYRKFHNSAASKNHYLITRHMLVKEVDLILENQSKYYGILDDKTIAKIKDIIFAQRDFEIGPGKNERFRRFTGYLDSIGKCQFFKDQERGSRFTVIADIYAFVNVLSQYTYTNNRGESVFDTSFANDLINSALKNGSMDKRELKAIAKSYHIDISDKNSDTSLTKCFKYIKVVKPLFEKYGYDWDKLIENYTDTDNNVLNRIGIVLSQAQTPKRRREKLKALNIGLDDGLINELTKLKLSGTANVSYKYMQGSIEAFCEGDLYGKYQAKFNKEIPDIDENAKPQKLPPFKNEDDCEFFKNPVVFRSINETRKLINAIIDKYGYPAAVNIETADELNKTFEDRAIDTKRNNDNQKENDRIVKEIIECIKCDEVHARHLIEKYKLWEAQEGKCLYSGETITKEDMLRDKDKLFEVDHIVPYSLILDNTINNKALVYAEENQKKGQRTPLMYMNEAQAADYRVRVNTMFKSKKCSKKKYQYLMLPDLNDQELLGGWRSRNLNDTRYICKYLVNYLRKNLRFDRSYESSDEDDLKIRDHYRVFPVKSRFTSMFRRWWLNEKTWGRYDKAELKKLTYLDHAADAIIIANCRPEYVVLAGEKLKLNKMYHQAGKRITPEYEQSKKACIDNLYKLFRMDRRTAEKLLSGHGRLTPIIPNLSEEVDKRLWDKNIYEQFWKDDKDKKSCEELYRENVASLYKGDPKFASSLSMPVISLKPDHKYRGTITGEEAIRVKEIDGKLIKLKRKSISEITAESINSIYTDDKILIDSLKTIFEQADYKDVGDYLKKTNQHFFTTSSGKRVNKVTVIEKVPSRWLRKEIDDNNFSLLNDSSYYCIELYKDSKGDNNLQGIAMSDIVHDRKTKKLYLKPDFNYPDDYYTHVMYIFPGDYLRIKSTSKKSGEQLKFEGYFISVKNVNENSFRFISDNKPCAKDKRVSITKKDIVIKLAVDLMGKVQGENNGKGISCGEPLSLLKEKN

SEQ ID NO: 303 - protein, 1187 aa, Unknown
  Cas9 variant
MLSRQLLGASHLARPVSYSYNVQDNDVHCSYGERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 304 - protein, 1150 aa, Unknown
  Cas9 variant
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSRGEIYKVTLHILKKRGISYLDEVDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTSFVKVSRYHYAVKEETGEKVMREIDFETGEIVNEMSYWEFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLFYEKEPKNIIK

SEQ ID NO: 305 - protein, 1236 aa, Unknown
  Cas9 variant
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 306 - protein, 1105 aa, Unknown
  Cas9 variant
MDNKNYRIGIDVGLNSIGFCAVEVDQHDTPLGFLNLSVYRHDAGIDPNGKKTNTTRLAMSGVARRTRRLFRKRKRRLAALDRFIEAQGWTLPDHADYKDPYTPWLVRAELAQTPIRDENDLHEKLAIAVRHIARHRGWRSPWVPVRSLHVEQPPSDQYLALKERVEAKTLLQMPEGATPAEMVVALDLSVDVNLRPKNREKTDTRPENKKPGFLGGKLMQSDNANELRKIAKIQGLDDALLRELIELVFAADSPKGASGELVGYDVLPGQHGKRRAEKAHPAFQRYRIASIVSNLRIRHLGSGADERLDVETQKRVFEYLLNAKPTADITWSDVAEEIGVERNLLMGTATQTADGERASAKPPVDVTNVAFATCKIKPLKEWWLNADYEARCVMVSALSHAEKLTEGTAAEVEVAEFLQNLSDEDNEKLDSFSLPIGRAAYSVDSLERLTKRMIENGEDLFEARVNEFGVSEDWRPPAEPIGARVGNPAVDRVLKAVNRYLMAAEAEWGAPLSVNIEHVREGFISKRQAVEIDRENQKRYQRNQAVRSQIADHINATSGVRGSDVTRYLAIQRQNGECLYCGTAITFVNSEMDHIVPRAGLGSTNTRDNLVATCERCNKSKSNKPFAVWAAECGIPGVSVAEALKRVDFWIADGFASSKEHRELQKGVKDRLKRKVSDPEIDNRSMESVAWMARELAHRVQYYFDEKHTGTKVRVFRGSLTSAARKASGFESRVNFIGGNGKTRLDRRHHAMDAATVAMLRNSVAKTLVLRGNIRASERAIGAAETWKSFRGENVADRQIFESWSENMRVLVEKFNLALYNDEVSIFSSLRLQLGNGKAHDDTITKLQMHKVGDAWSLTEIDRASTPALWCALTRQPDFTWKDGLPANEDRTIIVNGTHYGPLDKVGIFGKAAASLLVRGGSVDIGSAIHHARIYRIAGKKPTYGMVRVFAPDLLRYRNEDLFNVELPPQSVSMRYAEPKVREAIREGKAEYLGWLVVGDELLLDLSSETSGQIAELQQDFPGTTHWTVAGFFSPSRLRLRPVYLAQEGLGEDVSEGSKSIIAGQGWRPAVNKVFGSAMPEVIRRDGLGRKRRFSYSGLPVSWQG

SEQ ID NO: 307 - protein, 1079 aa, Unknown
  Cas9 variant
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 308 - protein, 1181 aa, Unknown
  Cas9 variant
MLHCIAVIRVPPSEEPGFFETHADSCALCHHGCMTYAANDKAIRYRVGIDVGLRSIGFCAVEVDDEDHPIRILNSVVHVHDAGTGGPGETESLRKRSGVAARARRRGRAEKQRLKKLDVLLEELGWGVSSNELLDSHAPWHIRKRLVSEYIEDETERRQCLSVAMAHIARHRGWRNSFSKVDTLLLEQAPSDRMQGLKERVEDRTGLQFSEEVTQGELVATLLEHDGDVTIRGFVRKGGKATKVHGVLEGKYMQSDLVAELRQICRTQRVSETTFEKLVLSIFHSKEPAPSAARQRERVGLDELQLALDPAAKQPRAERAHPAFQKFKVVATLANMRIREQSAGERSLTSEELNRVARYLLNHTESESPTWDDVARKLEVPRHRLRGSSRASLETGGGLTYPPVDDTTVRVMSAEVDWLADWWDCANDESRGHMIDAISNGCGSEPDDVEDEEVNELISSATAEDMLKLELLAKKLPSGRVAYSLKTLREVTAAILETGDDLSQAITRLYGVDPGWVPTPAPIEAPVGNPSVDRVLKQVARWLKFASKRWGVPQTVNIEHTREGLKSASLLEEERERWERFEARREIRQKEMYKRLGISGPFRRSDQVRYEILDLQDCACLYCGNEINFQTFEVDHIIPRVDASSDSRRTNLAAVCHSCNSAKGGLAFGQWVKRGDCPSGVSLENAIKRVRSWSKDRLGLTEKAMGKRKSEVISRLKTEMPYEEFDGRSMESVAWMAIELKKRIEGYFNSDRPEGCAAVQVNAYSGRLTACARRAAHVDKRVRLIRLKGDDGHHKNRFDRRNHAMDALVIALMTPAIARTIAVREDRREAQQLTRAFESWKNFLGSEERMQDRWESWIGDVEYACDRLNELIDADKIPVTENLRLRNSGKLHADQPESLKKARRGSKRPRPQRYVLGDALPADVINRVTDPGLWTALVRAPGFDSQLGLPADLNRGLKLRGKRISADFPIDYFPTDSPALAVQGGYVGLEFHHARLYRIIGPKEKVKYALLRVCAIDLCGIDCDDLFEVELKPSSISMRTADAKLKEAMGNGSAKQIGWLVLGDEIQIDPTKFPKQSIGKFLKECGPVSSWRVSALDTPSKITLKPRLLSNEPLLKTSRVGGHESDLVVAECVEKIMKKTGWVVEINALCQSGLIRVIRRNALGEVRTSPKSGLPISLNLR

SEQ ID NO: 309 - protein, 1113 aa, Unknown
  Cas9 variant
MRYRVGLDLGTASVGAAVFSMDEQGNPMELIWHYERLFSEPLVPDMGQLKPKKAARRLARQQRRQIDRRASRLRRIAIVSRRLGIAPGRNDSGVHGNDVPTLRAMAVNERIELGQLRAVLLRMGKKRGYGGTFKAVRKVGEAGEVASGASRLEEEMVALASVQNKDSVTVGEYLAARVEHGLPSKLKVAANNEYYAPEYALFRQYLGLPAIKGRPDCLPNMYALRHQIEHEFERIWATQSQFHDVMKDHGVKEEIRNAIFFQRPLKSPADKVGRCSLQTNLPRAPRAQIAAQNFRIEKQMADLRWGMGRRAEMLNDHQKAVIRELLNQQKELSFRKIYKELERAGCPGPEGKGLNMDRAALGGRDDLSGNTTLAAWRKLGLEDRWQELDEVTQIQVINFLADLGSPEQLDTDDWSCRFMGKNGRPRNFSDEFVAFMNELRMTDGFDRLSKMGFEGGRSSYSIKALKALTEWMIAPHWRETPETHRVDEEAAIRECYPESLATPAQGGRQSKLEPPPLTGNEVVDVALRQVRHTINMMIDDLGSVPAQIVVEMAREMKGGVTRRNDIEKQNKRFASERKKAAQSIEENGKTPTPARILRYQLWIEQGHQCPYCESNISLEQALSGAYTNFEHILPRTLTQIGRKRSELVLAHRECNDEKGNRTPYQAFGHDDRRWRIVEQRANALPKKSSRKTRLLLLKDFEGEALTDESIDEFADRQLHESSWLAKVTTQWLSSLGSDVYVSRGSLTAELRRRWGLDTVIPQVRFESGMPVVDEEGAEITPEEFEKFRLQWEGHRVTREMRTDRRPDKRIDHRHHLVDAIVTALTSRSLYQQYAKAWKVADEKQRHGRVDVKVELPMPILTIRDIALEAVRSVRISHKPDRYPDGRFFEATAYGIAQRLDERSGEKVDWLVSRKSLTDLAPEKKSIDVDKVRANISRIVGEAIRLHISNIFEKRVSKGMTPQQALREPIEFQGNILRKVRCFYSKADDCVRIEHSSRRGHHYKMLLNDGFAYMEVPCKEGILYGVPNLVRPSEAVGIKRAPESGDFIRFYKGDTVKNIKTGRVYTIKQILGDGGGKLILTPVTETKPADLLSAKWGRLKVGGRNIHLLRLCAE

SEQ ID NO: 310 - protein, 1052 aa, Unknown
  Cas9 variant
MIGEHVRGGCLFDDHWTPNWGAFRLPNTVRTFTKAENPKDGSSLAEPRRQARGLRRRLRRKTQRLEDLRRLLAKEGVLSLSDLETLFRETPAKDPYQLRAEGLDRPLSFPEWVRVLYHITKHRGFQSNRRNPVEDGQERSRQEEEGKLLSGVGENERLLREGGYRTAGEMLARDPKFQDHRRNRAGDYSHTLSRSLLLEEARRLFQSQRTLGNPHASSNLEEAFLHLVAFQNPFASGEDIRNKAGHCSLEPDQIRAPRRSASAETFMLLQKTGNLRLIHRRTGEERPLTDKEREQIHLLAWKQEKVTHKTLRRHLEIPEEWLFTGLPYHRSGDKAEEKLFVHLAGIHEIRKALDKGPDPAVWDTLRSRRDLLDSIADTLTFYKNEDEILPRLESLGLSPENARALAPLSFSGTAHLSLSALGKLLPHLEEGKSYTQARADAGYAAPPPDRHPKLPPLEEADWRNPVVFRALTQTRKVVNALVRRYGPPWCIHLETARELSQPAKVRRRIETEQQANEKKKQQAEREFLDIVGTAPGPGDLLKMRLWREQGGFCPYCEEYLNPTRLAEPGYAEMDHILPYSRSLDNGWHNRVLVHGKDNRDKGNRTPFEAFGGDTARWDRLVAWVQASHLSAPKKRNLLREDFGEEAERELKDRNLTDTRFITKTAATLLRDRLTFHPEAPKDPVMTLNGRLTAFLRKQWGLHKNRKNGDLHHALDAAVLAVASRSFVYRLSSHNAAWGELPRGREAENGFSLPYPAFRSEVLARLCPTREEILLRLDQGGVGYDEAFRNGLRPVFVSRAPSRRLRGKAHMETLRSPKWKDHPEGPRTASRIPLKDLNLEKLERMVGKDRDRKLYEALRERLAAFGGNGKKAFVAPFRKPCRSGEGPLVRSLRIFDSGYSGVELRDGGEVYAVADHESMVRVDVYAKKNRFYLVPVYVADVARGIVKNRAIVAHKSEEEWDLVDGSFDFRFSLFPGDLVEIEKKDGAYLGYYKSCHRGDGRLLLDRHDRMPRESDCGTFYVSTRKDVLSMSKYQVDPLGEIRLVGSEKPPFVL

SEQ ID NO: 311 - protein, 1233 aa, Unknown
  Cas9 variant
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDEILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTASYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIATKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 312 - protein, 1119 aa, Unknown
  Cas9 variant
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 313 - protein, 1195 aa, Unknown
  Cas9 variant
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 314 - skipped

SEQ ID NO: 315 - protein, 1056 aa, Unknown
  Cas9 variant
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 316 - protein, 1059 aa, Unknown
  Cas9 variant
MGIRFAFDLGTNSIGWAVWRTGPGVFGEDTAASLDGSGVLIFKDGRNPKDGQSLATMRRVPRQSRKRRDRFVLRRRDLLAALRKAGLFPVDVEEGRRLAATDPYHLRAKALDESLTPHEMGRVIFHLNQRRGFRSNRKADRQDREKGKIAEGSKRLAETLAATNCRTLGEFLWSRHRGTPRTRSPTRIRMEGEGAKALYAFYPTREMVRAEFERLWTAQSRFAPDLLTPERHEEIAGILFRQRDLAPPKIGCCTFEPSERRLPRALPSVEARGIYERLAHLRITTGPVSDRGLTRPERDVLASALLAGKSLTFKAVRKTLKILPHALVNFEEAGEKGLDGALTAKLLSKPDHYGAAWHGLSFAEKDTFVGKLLDEADEERLIRRLVTENRLSEDAARRCASIPLADGYGRLGRTANTEILAALVEETDETGTVVTYAEAVRRAGERTGRNWHHSDERDGVILDRLPYYGEILQRHVVPGSGEPEEKNEAARWGRLANPTVHIGLNQLRKVVNRLIAAHGRPDQIVVELARELKLNREQKERLDRENRKNREENERRTAILAEHGQRDTAENKIRLRLFEEQARANAGIALCPYTGRAIGIAELFTSEVEIDHILPVSLTLDDSLANRVLCRREANREKRRQTPFQAFGATPAWNDIVARAAKLPPNKRWRFDPAALERFEREGGFLGRQLNETKYLSRLAKIYLGKICDPDRVYVTPGTLTGLLRARWGLNSILSDSNFKNRSDHRHHAVDAVVIGVLTRGMIQRIAHDAARAEDQDLDRVFRDVPVPFEDFRDHVRERVSTITVAVKPEHGKGGALHEDTSYGLVPDTDPNAALGNLVVRKPIRSLTAGEVDRVRDRALRARLGALAAPFRDESGRVRDAKGLAQALEAFGAENGIRRVRILKPDASVVTIADRRTGVPYRAVAPGENHHVDIVQMRDGSWRGFAASVFEVNRPGWRPEWEVKKLGGKLVMRLHKGDMVELSDKDGQRRVKVVQQIEISANRVRLSPHNDGGKLQDRHADADDPFRWDLATIPLLKDRGCVAVRVDPIGVVTLRRSNV

SEQ ID NO: 317 - protein, 1096 aa, Unknown
  Cas9 variant
MMEVFMGRLVLGLDIGITSVGFGIIDLDESEIVDYGVRLFKEGTAAENETRRTKRGGRRLKRRRVTRREDMLHLLKQAGIISTSFHPLNNPYDVRVKGLNERLNGEELATALLHLCKHRGSSVETIEDDEAKAKEAGETKKVLSMNDQLLKSGKYVCEIQKERLRTNGHIRGHENNFKTRAYVDEAFQILSHQDLSNELKSAIITIISRKRMYYDGPGGPLSPTPYGRYTYFGQKEPIDLIEKMRGKCSLFPNEPRAPKLAYSAELFNLLNDLNNLSIEGEKLTSEQKAMILKIVHEKGKITPKQLAKEVGVSLEQIRGFRIDTKGSPLLSELTGYKMIREVLEKSNDEHLEDHVFYDEIAEILTKTKDIEGRKKQISELSSDLNEESVHQLAGLTKFTAYHSLSFKALRLINEEMLKTELNQMQSITLFGLKQNNELSVKGMKNIQADDTAILSPVAKRAQRETFKVVNRLREIYGEFDSIVVEMAREKNSEEQRKAIRERQKFFEMRNKQVADIIGDDRKINAKLREKLVLYQEQDGKTAYSLEPIDLKLLIDDPNAYEVDHIIPISISLDDSITNKVLVTHRENQEKGNLTPISAFVKGRFTKGSLAQYKAYCLKLKEKNIKTNKGYRKKVEQYLLNENDIYKYDIQKEFINRNLVDTSYASRVVLNTLTTYFKQNEIPTKVFTVKGSLTNAFRRKINLKKDRDEDYGHHAIDALIIASMPKMRLLSTIFSRYKIEDIYDESTGEVFSSGDDSMYYDDRYFAFIASLKAIKVRKFSHKIDTKPNRSVADETIYSTRVIDGKEKVVKKYKDIYDPKFTALAEDILNNAYQEKYLMALHDPQTFDQIVKVVNYYFEEMSKSEKYFTKDKKGRIKISGMNPLSLYRDEHGMLKKYSKKGDGPAITQMKYFDGVLGNHIDISAHYQVRDKKVVLQQISPYRTDFYYSKENGYKFVTIRYKDVRWSEKKKKYVIDQQDYAMKKAEKKIDDTYEFQFSMHRDELIGITKAEGEALIYPDETWHNFNFFFHAGETPEILKFTATNNDKSNKIEVKPIHCYCKMRLMPTISKKIVRIDKYATDVVGNLYKVKKNTLKFEFD

SEQ ID NO: 318 - protein, 1132 aa, Unknown
  Cas9 variant
MKKILGVDLGITSFGYAILQETGKDLYRCLDNSVVMRNNPYDEKSGESSQSIRSTQKSMRRLIEKRKKRIRCVAQTMERYGILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKSLRHLHLREGNLFEKEENPINNHAVKSLASWALGLIADLSWRYGPFDEIILETTRDALPEKIRKEIDKAMREREKALDKIIGKYKKEFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTENTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSISYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRKMRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 319 - protein, 1173 aa, Unknown
  Cas9 variant
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 320 - protein, 1021 aa, Unknown
  Cas9 variant
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 321 - protein, 1024 aa, Unknown
  Cas9 variant
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 322 - protein, 1092 aa, Unknown
  Cas9 variant
MKYSIGLDIGIASVGWSVINKDKERIEDMGVRIFQKAENPKDGSSLASSRREKRGSRRRNRRKKHRLDRIKNILCESGLVKKNEIEKIYKNAYLKSPWELRAKSLEAKISNKEIAQILLHIAKRRGFKSFRKTDRNADDTGKLLSGIQENKKIMEEKGYLTIGDMVAKDPKFNTHVRNKAGSYLFSFSRKLLEDEVRKIQAKQKELGNTHFTDDVLEKYIEVFNSQRNFDEGPSKPSPYYSEIGQIAKMIGNCTFESSEKRTAKNTWSGERFVFLQKLNNFRIVGLSGKRPLTEEERDIVEKEVYLKKEVRYEKLRKILYLKEEERFGDLNYSKDEKQDKKTEKTKFISLIGNYTIKKLNLSEKLKSEIEEDKSKLDKIIEILTFNKSDKTIESNLKKLELSREDIEILLSEEFSGTLNLSLKAIKKILPYLEKGLSYNEACEKADYDYKNNGIKFKRGELLPVVDKDLIANPVVLRAISQTRKVVNAIIRKYGTPHTIHVEVARDLAKSYDDRQTIIKENKKRELENEKTKKFISEEFGIKNVKGKLLLKYRLYQEQEGRCAYSRKELSLSEVILDESMTDIDHIIPYSRSMDDSYSNKVLVLSGENRKKSNLLPKEYFDRQGRDWDTFVLNVKAMKIHPRKKSNLLKEKFTREDNKDWKSRALNDTRYISRFVANYLENALEYRDDSPKKRVFMIPGQLTAQLRARWRLNKVRENGDLHHALDAAVVAVTDQKAINNISNISRYKELKNCKDVIPSIEYHADEETGEVYFEEVKDTRFPMPWSGFDLELQKRLESENPREEFYNLLSDKRYLGWFNYEEGFIEKLRPVFVSRMPNRGVKGQAHQETIRSSKKISNQIAVSKKPLNSIKLKDLEKMQGRDTDRKLYEALKNRLEEYDDKPEKAFAEPFYKPTNSGKRGPLVRGIKVEEKQNVGVYVNGGQASNGSMVRIDVFRKNGKFYTVPIYVHQTLLKELPNRAINGKPYKDWDLIDGSFEFLYSFYPNDLIEIEFGKSKSIKNDNKLTKTEIPEVNLSEVLGYYRGMDTSTGAATIDTQDGKIQMRIGIKTVKNIKKYQVDVLGNVYKVKREKRQTF

SEQ ID NO: 323 - protein, 1179 aa, Unknown
  Cas9 variant
MSKKVSRRYEEQAQEICQRLGSRPYSIGLDLGVGSIGVAVAAYDPIKKQPSDLVFVSSRIFIPSTGAAERRQKRGQRNSLRHRANRLKFLWKLLAERNLMLSYSEQDVPDPARLRFEDAVVRANPYELRLKGLNEQLTLSELGYALYHIANHRGSSSVRTFLDEEKSSDDKKLEEQQAMTEQLAKEKGISTFIEVLTAFNTNGLIGYRNSESVKSKGVPVPTRDIISNEIDVLLQTQKQFYQEILSDEYCDRIVSAILFENEKIVPEAGCCPYFPDEKKLPRCHFLNEERRLWEAINNARIKMPMQEGAAKRYQSASFSDEQRHILFHIARSGTDITPKLVQKEFPALKTSIIVLQGKEKAIQKIAGFRFRRLEEKSFWKRLSEEQKDDFFSAWTNTPDDKRLSKYLMKHLLLTENEVVDALKTVSLIGDYGPIGKTATQLLMKHLEDGLTYTEALERGMETGEFQELSVWEQQSLLPYYGQILTGSTQALMGKYWHSAFKEKRDSEGFFKPNTNSDEEKYGRIANPVVHQTLNELRKLMNELITILGAKPQEITVELARELKVGAEKREDIIKQQTKQEKEAVLAYSKYCEPNNLDKRYIERFRLLEDQAFVCPYCLEHISVADIAAGRADVDHIFPRDDTADNSYGNKVVAHRQCNDIKGKRTPYAAFSNTSAWGPIMHYLDETPGMWRKRRKFETNEEEYAKYLQSKGFVSRFESDNSYIAKAAKEYLRCLFNPNNVTAVGSLKGMETSILRKAWNLQGIDDLLGSRHWSKDADTSPTMRKNRDDNRHHGLDAIVALYCSRSLVQMINTMSEQGKRAVEIEAMIPIPGYASEPNLSFEAQRELFRKKILEFMDLHAFVSMKTDNDANGALLKDTVYSILGADTQGEDLVFVVKKKIKDIGVKIGDYEEVASAIRGRITDKQPKWYPMEMKDKIEQLQSKNEAALQKYKESLVQAAAVLEESNRKLIESGKKPIQLSEKTISKKALELVGGYYYLISNNKRTKTFVVKEPSNEVKGFAFDTGSNLCLDFYHDAQGKLCGEIIRKIQAMNPSYKPAYMKQGYSLYVRLYQGDVCELRASDLTEAESNLAKTTHVRLPNAKPGRTFVIIITFTEMGSGYQIYFSNLAKSKKGQDTSFTLTTIKNYDVRKVQLSSAGLVRYVSPLLVDKIEKDEVALCGE

SEQ ID NO: 324 - protein, 1054 aa, Unknown
  Cas9 variant
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 325 - protein, 1061 aa, Unknown
  Cas9 variant
MIMKLEKWRLGLDLGTNSIGWSVFSLDKDNSVQDLIDMGVRIFSDGRDPKTKEPLAVARRTARSQRKLIYRRKLRRKQVFKFLQEQGLFPKTKEECMTLKSLNPYELRIKALDEKLEPYELGRALFNLAVRRGFKSNRKDGSREEVSEKKSPDEIKTQADMQTHLEKAIKENGCRTITEFLYKNQGENGGIRFAPGRMTYYPTRKMYEEEFNLIRSKQEKYYPQVDWDDIYKAIFYQRPLKPQQRGYCIYENDKERTFKAMPCSQKLRILQDIGNLAYYEGGSKKRVELNDNQDKVLYELLNSKDKVTFDQMRKALCLADSNSFNLEENRDFLIGNPTAVKMRSKNRFGKLWDEIPLEEQDLIIETIITADEDDAVYEVIKKYDLTQEQRDFIVKNTILQSGTSMLCKEVSEKLVKRLEEIADLKYHEAVESLGYKFADQTVEKYDLLPYYGKVLPGSTMEIDLSAPETNPEKHYGKISNPTVHVALNQTRVVVNALIKEYGKPSQIAIELSRDLKNNVEKKAEIARKQNQRAKENIAINDTISALYHTAFPGKSFYPNRNDRMKYRLWSELGLGNKCIYCGKGISGAELFTKEIEIEHILPFSRTLLDAESNLTVAHSSCNAFKAERSPFEAFGTNPSGYSWQEIIQRANQLKNTSKKNKFSPNAMDSFEKDSSFIARQLSDNQYIAKAALRYLKCLVENPSDVWTTNGSMTKLLRDKWEMDSILCRKFTEKEVALLGLKPEQIGNYKKNRFDHRHHAIDAVVIGLTDRSMVQKLATKNSHKGNRIEIPEFPILRSDLIEKVKNIVVSFKPDHGAEGKLSKETLLGKIKLHGKETFVCRENIVSLSEKNLDDIVDEIKSKVKDYVAKHKGQKIEAVLSDFSKENGIKKVRCVNRVQTPIEITSGKISRYLSPEDYFAAVIWEIPGEKKTFKAQYIRRNEVEKNSKGLNVVKPAVLENGKPHPAAKQVCLLHKDDYLEFSDKGKMYFCRIAGYAATNNKLDIRPVYAVSYCADWINSTNETMLTGYWKPTPTQNWVSVNVLFDKQKARLVTVSPIGRVFRK

SEQ ID NO: 326 - protein, 1011 aa, Unknown
  Cas9 variant
MSSKAIDSLEQLDLFKPQEYTLGLDLGIKSIGWAILSGERIANAGVYLFETAEELNSTGNKLISKAAERGRKRRIRRMLDRKARRGRHIRYLLEREGLPTDELEEVVVHQSNRTLWDVRAEAVERKLTKQELAAVLFHLVRHRGYFPNTKKLPPDDESDSADEEQGKINRATSRLREELKASDCKTIGQFLAQNRDRQRNREGDYSNLMARKLVFEEALQILAFQRKQGHELSKDFEKTYLDVLMGQRSGRSPKLGNCSLIPSELRAPSSAPSTEWFKFLQNLGNLQISNAYREEWSIDAPRRAQIIDACSQRSTSSYWQIRRDFQIPDEYRFNLVNYERRDPDVDLQEYLQQQERKTLANFRNWKQLEKIIGTGHPIQTLDEAARLITLIKDDEKLSDQLADLLPEASDKAITQLCELDFTTAAKISLEAMYRILPHMNQGMGFFDACQQESLPEIGVPPAGDRVPPFDEMYNPVVNRVLSQSRKLINAVIDEYGMPAKIRVELARDLGKGRELRERIKLDQLDKSKQNDQRAEDFRAEFQQAPRGDQSLRYRLWKEQNCTCPYSGRMIPVNSVLSEDTQIDHILPISQSFDNSLSNKVLCFTEENAQKSNRTPFEYLDAADFQRLEAISGNWPEAKRNKLLHKSFGKVAEEWKSRALNDTRYLTSALADHLRHHLPDSKIQTVNGRITGYLRKQWGLEKDRDKHTHHAVDAIVVACTTPAIVQQVTLYHQDIRRYKKLGEKRPTPWPETFRQDVLDVEEEIFITRQPKKVSGGIQTKDTLRKHRSKPDRQRVALTKVKLADLERLVEKDASNRNLYEHLKQCLEESGDQPTKAFKAPFYMPSGPEAKQRPILSKVTLLREKPEPPKQLTELSGGRRYDSMAQGRLDIYRYKPGGKRKDEYRVVLQRMIDLMRGEENVHVFQKGVPYDQGPEIEQNYTFLFSLYFDDLVEFQRSADSEVIRGYYRTFNIANGQLKISTYLEGRQDFDFFGANRLAHFAKVQVNLLGKVIK

SEQ ID NO: 327 - protein, 1029 aa, Unknown
  Cas9 variant
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 328 - protein, 1168 aa, Unknown
  Cas9 variant
MARPAFRAPRREHVNGWTPDPHRISKPFFILVSWHLLSRVVIDSSSGCFPGTSRDHTDKFAEWECAVQPYRLSFDLGTNSIGWGLLNLDRQGKPREIRALGSRIFSDGRDPQDKASLAVARRLARQMRRRRDRYLTRRTRLMGALVRFGLMPADPAARKRLEVAVDPYLARERATRERLEPFEIGRALFHLNQRRGYKPVRTATKPDEEAGKVKEAVERLEAAIAAAGAPTLGAWFAWRKTRGETLRARLAGKGKEAAYPFYPARRMLEAEFDTLWAEQARHHPDLLTAEAREILRHRIFHQRPLKPPPVGRCTLYPDDGRAPRALPSAQRLRLFQELASLRVIHLDLSERPLTPAERDRIVAFVQGRPPKAGRKPGKVQKSVPFEKLRGLLELPPGTGFSLESDKRPELLGDETGARIAPAFGPGWTALPLEEQDALVELLLTEAEPERAIAALTARWALDEATAAKLAGATLPDFHGRYGRRAVAELLPVLERETRGDPDGRVRPIRLDEAVKLLRGGKDHSDFSREGALLDALPYYGAVLERHVAFGTGNPADPEEKRVGRVANPTVHIALNQLRHLVNAILARHGRPEEIVIELARDLKRSAEDRRREDKRQADNQKRNEERKRLILSLGERPTPRNLLKLRLWEEQGPVENRRCPYSGETISMRMLLSEQVDIDHILPFSVSLDDSAANKVVCLREANRIKRNRSPWEAFGHDSERWAGILARAEALPKNKRWRFAPDALEKLEGEGGLRARHLNDTRHLSRLAVEYLRCVCPKVRVSPGRLTALLRRRWGIDAILAEADGPPPEVPAETLDPSPAEKNRADHRHHALDAVVIGCIDRSMVQRVQLAAASAEREAAAREDNIRRVLEGFKEEPWDGFRAELERRARTIVVSHRPEHGIGGALHKETAYGPVDPPEEGFNLVVRKPIDGLSKDEINSVRDPRLRRALIDRLAIRRRDANDPATALAKAAEDLAAQPASRGIRRVRVLKKESNPIRVEHGGNPSGPRSGGPFHKLLLAGEVHHVDVALRADGRRWVGHWVTLFEAHGGRGADGAAAPPRLGDGERFLMRLHKGDCLKLEHKGRVRVMQVVKLEPSSNSVVVVEPHQVKTDRSKHVKISCDQLRARGARRVTVDPLGRVRVHAPGARVGIGGDAGRTAMEPAEDIS

SEQ ID NO: 329 - protein, 1064 aa, Unknown
  Cas9 variant
MKRTSLRAYRLGVDLGANSLGWFVVWLDDHGQPEGLGPGGVRIFPDGRNPQSKQSNAAGRRLARSARRRRDRYLQRRGKLMGLLVKHGLMPADEPARKRLECLDPYGLRAKALDEVLPLHHVGRALFHLNQRRGLFANRAIEQGDKDASAIKAAAGRLQTSMQACGARTLGEFLNRRHQLRATVRARSPVGGDVQARYEFYPTRAMVDAEFEAIWAAQAPHHPTMTAEAHDTIREAIFSQRAMKRPSIGKCSLDPATSQDDVDGFRCAWSHPLAQRFRIWQDVRNLAVVETGPTSSRLGKEDQDKVARALLQTDQLSFDEIRGLLGLPSDARFNLESDRRDHLKGDATGAILSARRHFGPAWHDRSLDRQIDIVALLESALDEAAIIASLGTTHSLDEAAAQRALSALLPDGYCRLGLRAIKRVLPLMEAGRTYAEAASAAGYDHALLPGGKLSPTGYLPYYGQWLQNDVVGSDDERDTNERRWGRLPNPTVHIGIGQLRRVVNELIRWHGPPAEITVELTRDLKLSPRRLAELEREQAENQRKNDKRTSLLRKLGLPASTHNLLKLRLWDEQGDVASECPYTGEAIGLERLVSDDVDIDHLIPFSISWDDSAANKVVCMRYANREKGNRTPFEAFGHRQGRPYDWADIAERAARLPRGKRWRFGPGARAQFEELGDFQARLLNETSWLARVAKQYLAAVTHPHRIHVLPGRLTALLRATWELNDLLPGSDDRAAKSRKDHRHHAIDALVAALTDQALLRRMANAHDDTRRKIEVLLPWPTFRIDLETRLKAMLVSHKPDHGLQARLHEDTAYGTVEHPETEDGANLVYRKTFVDISEKEIDRIRDRRLRDLVRAHVAGERQQGKTLKAAVLSFAQRRDIAGHPNGIRHVRLTKSIKPDYLVPIRDKAGRIYKSYNAGENAFVDILQAESGRWIARATTVFQANQANESHDAPAAQPIMRVFKGDMLRIDHAGAEKFVKIVRLSPSNNLLYLVEHHQAGVFQTRHDDPEDSFRWLFASFDKLREWNAELVRIDTLGQPWRRKRGLETGSEDATRIGWTRPKKWP

SEQ ID NO: 330 - protein, 1037 aa, Unknown
  Cas9 variant
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 331 - protein, 1218 aa, Unknown
  Cas9 variant
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYDAQGNKVRIRQRYTDRNKHYQHEFDAICEKQELSSELIEDLQRAIFFQLPLKSQRHGVGRCTFERGKPRCADSHPDYEEFRMLCFVNNIQVKGPHDLELRPLTYEEREKIEPLFFRKSKPNFDFEDIAKALAGKKNYAWIHDKEERAYKFNYRMTQGVPGCPTIAQLKSIFGDDWKTGIAETYTLIQKKNGSKSLQEMVDDVWNVLYSFSSVEKLKEFAHHKLQLDEESAEKFAKIKLSHSFAALSLKAIRKFLPFLRKGMYYTHASFFANIPTIVGKEIWNKEQNRKYIMENVGELVFNYQPKHREVQGTIEMLIKDFLANNFELPAGATDKLYHPSMIETYPNAQRNEFGILQLGSPRTNAIRNPMAMRSLHILRRVVNQLLKESIIDENTEVHVEYARELNDANKRRAIADRQKEQDKQHKKYGDEIRKLYKEETGKDIEPTQTDVLKFQLWEEQNHHCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYRMEETFKQGRGSKPKFSKPWATFTEDVLNIYKNLLVVHDTPNNMPKHTKKYVQTSIGKVLAQGDTARGSLHLDTYYGAIERDGEIRYVVRRPLSSFTKPEELENIVDETVKRTIKEAIADKNFKQAIAEPIYMNEEKGILIKKVRCFAKSVKQPINIRQHRDLSKKEYKQQYHVMNENNYLLAIYEGLVKNKVVREFEIVSYIEAAKYYKRSQDRNIFSSIVPTHSTKYGLPLKTKLLMGQLVLMFEENPDEIQVDNTKDLVKRLYKVVGIEKDGRIKFKYHQEARKEGLPIFSTPYKNNDDYAPIFRQSINNINILVDGIDFTIDILGKVTLKE

SEQ ID NO: 332 - protein, 1088 aa, Unknown
  Cas9 variant
MNYKMGLDIGIASVGWAVINLDLKRIEDLGVRIFDKAEHPQNGESLALPRRIARSARRRLRRRKHRLERIRRLLVSENVLTKEEMNLLFKQKKQIDVWQLRVDALERKLNNDELARVLLHLAKRRGFKSNRKSERNSKESSEFLKNIEENQSILAQYRSVGEMIVKDSKFAYHKRNKLDSYSNMIARDDLEREIKLIFEKQREFNNPVCTERLEEKYLNIWSSQRPFASKEDIEKKVGFCTFEPKEKRAPKATYTFQSFIVWEHINKLRLVSPDETRALTEIERNLLYKQAFSKNKMTYYDIRKLLNLSDDIHFKGLLYDPKSSLKQIENIRFLELDSYHKIRKCIENVYGKDGIRMFNETDIDTFGYALTIFKDDEDIVAYLQNEYITKNGKRVSNLANKVYDKSLIDELLNLSFSKFAHLSMKAIRNILPYMEQGEIYSKACELAGYNFTGPKKKEKALLLPVIPNIANPVVMRALTQSRKVVNAIIKKYGSPVSIHIELARDLSHSFDERKKIQKDQTENRKKNETAIKQLIEYELTKNPTGLDIVKFKLWSEQQGRCMYSLKPIELERLLEPGYVEVDHILPYSRSLDDSYANKVLVLTKENREKGNHTPVEYLGLGSERWKKFEKFVLANKQFSKKKKQNLLRLRYEETEEKEFKERNLNDTRYISKFFANFIKEHLKFADGDGGQKVYTINGKITAHLRSRWDFNKNREESDLHHAVDAVIVACATQGMIKKITEFYKAREQNKESAKKKEPIFPQPWPHFADELKARLSKFPQESIEAFALGNYDRKKLESLRPVFVSRMPKRSVTGAAHQETLRRCVGIDEQSGKIQTAVKTKLSDIKLDKDGHFPMYQKESDPRTYEAIRQRLLEHNNDPKKAFQEPLYKPKKNGEPGPVIRTVKIIDTKNKVVHLDGSKTVAYNSNIVRTDVFEKDGKYYCVPVYTMDIMKGTLPNKAIEANKPYSEWKEMTEEYTFQFSLFPNDLVRIVLPREKTIKTSTNEEIIIKDIFAYYKTIDSATGGLELISHDRNFSLRGVGSKTLKRFEKYQVDVLGNIHKVKGEKRVGLAAPTNQKKGKTVDSLQSVSD

SEQ ID NO: 333 - protein, 1035 aa, Unknown
  Cas9 variant
MRRLGLDLGTNSIGWCLLDLGDDGEPVSIFRTGARIFSDGRDPKSLGSLKATRREARLTRRRRDRFIQRQKNLINALVKYGLMPADEIQRQALAYKDPYPIRKKALDEAIDPYEMGRAIFHINQRRGFKSNRKSADNEAGVVKQSIADLEMKLGEAGARTIGEFLADRQATNDTVRARRLSGTNALYEFYPDRYMLEQEFDTLWAKQAAFNPSLYIEAARERLKEIVFFQRKLKPQEVGRCIFLSDEDRISKALPSFQRFRIYQELSNLAWIDHDGVAHRITASLALRDHLFDELEHKKKLTFKAMRAILRKQGVVDYPVGFNLESDNRDHLIGNLTSCIMRDAKKMIGSAWDRLDEEEQDSFILMLQDDQKGDDEVRSILTQQYGLSDDVAEDCLDVRLPDGHGSLSKKAIDRILPVLRDQGLIYYDAVKEAGLGEANLYDPYAALSDKLDYYGKALAGHVMGASGKFEDSDEKRYGTISNPTVHIALNQVRAVVNELIRLHGKPDEVVIEIGRDLPMGADGKRELERFQKEGRAKNERARDELKKLGHIDSRESRQKFQLWEQLAKEPVDRCCPFTGKMMSISDLFSDKVEIEHLLPFSLTLDDSMANKTVCFRQANRDKGNRAPFDAFGNSPAGYDWQEILGRSQNLPYAKRWRFLPDAMKRFEADGGFLERQLNDTRYISRYTTEYISTIIPKNKIWVVTGRLTSLLRGFWGLNSILRGHNTDDGTPAKKSRDDHRHHAIDAIVVGMTSRGLLQKVSKAARRSEDLDLTRLFEGRIDPWDGFRDEVKKHIDAIIVSHRPRKKSQGALHNDTAYGIVEHAENGASTVVHRVPITSLGKQSDIEKVRDPLIKSALLNETAGLSGKSFENAVQKWCADNSIKSLRIVETVSIIPITDKEGVAYKGYKGDGNAYMDIYQDPTSSKWKGEIVSRFDANQKGFIPSWQSQFPTARLIMRLRINDLLKLQDGEIEEIYRVQRLSGSKILMAPHTEANVDARDRDKNDTFKLTSKSPGKLQSASARKVHISPTGLIREG

SEQ ID NO: 334 - protein, 1153 aa, Unknown
  Cas9 variant
MKNILGLDLGLSSIGWSVIRENSEEQELVAMGSRVVSLTAAELSSFTQGNGVSINSQRTQKRTQRKGYDRYQLRRTLLRNKLDTLGMLPDDSLSYLPKLQLWGLRAKAVTQRIELNELGRVLLHLNQKRGYKSIKSDFSGDKKITDYVKTVKTRYDELKEMRLTIGELFFRRLTENAFFRCKEQVYPRQAYVEEFDCIMNCQRKFYPDILTDETIRCIRDEIIYYQRPLKSCKYLVSRCEFEKRFYLNAAGKKTEAGPKVSPRTSPLFQVCRLWESINNIVVKDRRNEIVFISAEQRAALFDFLNTHEKLKGSDLLKLLGLSKTYGYRLGEQFKTGIQGNKTRVEIERALGNYPDKKRLLQFNLQEESSSMVNTETGEIIPMISLSFEQEPLYRLWHVLYSIDDREQLQSVLRQKFGIDDDEVLERLSAIDLVKAGFGNKSSKAIRRILPFLQLGMNYAEACEAAGYNHSNNYTKAENEARALLDRLPAIKKNELRQPVVEKILNQMVNVVNALMEKYGRFDEIRVELARELKQSKEERSNTYKSINKNQRENEQIAKRIVEYGVPTRSRIQKYKMWEESKHCCIYCGQPVDVGDFLRGFDVEVEHIIPKSLYFDDSFANKVCSCRSCNKEKNNRTAYDYMKSKGEKALSDYVERVNTMYTNNQISKTKWQNLLTPVDKISIDFIDRQLRESQYIARKAKEILTSICYNVTATSGSVTSFLRHVWGWDTVLHDLNFDRYKKVGLTEVIEVNHRGSVIRREQIKDWSKRFDHRHHAIDALTIACTKQAYIQRLNNLRAEEGPDFNKMSLERYIQSQPHFSVAQVREAVDRILVSFRAGKRAVTPGKRYIRKNRKRISVQSVLIPRGALSEESVYGVIHVWEKDEQGHVIQKQRAVMKYPITSINREMLDKEKVVDKRIHRILSGRLAQYNDNPKEAFAKPVYIDKECRIPIRTVRCFAKPAINTLVPLKKDDKGNPVAWVNPGNNHHVAIYRDEDGKYKERTVTFWEAVDRCRVGIPAIVTQPDTIWDNILQRNDISENVLESLPDVKWQFVLSLQQNEMFILGMNEEDYRYAMDQQDYALLNKYLYRVQKLSKSDYSFRYHTETSVEDKYDGKPNLKLSMQMGKLKRVSIKSLLGLNPHKVHISVLGEIKEIS

SEQ ID NO: 335 - protein, 1062 aa, Unknown
  Cas9 variant
MAEKQHRWGLDIGTNSIGWAVIALIEGRPAGLVATGSRIFSDGRNPKDGSSLAVERRGPRQMRRRRDRYLRRRDRFMQALINVGLMPGDAAARKALVTENPYVLRQRGLDQALTLPEFGRALFHLNQRRGFQSNRKTDRATAKESGKVKNAIAAFRAGMGNARTVGEALARRLEDGRPVRARMVGQGKDEHYELYIAREWIAQEFDALWASQQRFHAEVLADAARDRLRAILLFQRKLLPVPVGKCFLEPNQPRVAAALPSAQRFRLMQELNHLRVMTLADKRERPLSFQERNDLLAQLVARPKCGFDMLRKIVFGANKEAYRFTIESERRKELKGCDTAAKLAKVNALGTRWQALSLDEQDRLVCLLLDGENDAVLADALREHYGLTDAQIDTLLGLSFEDGHMRLGRSALLRVLDALESGRDEQGLPLSYDKAVVAAGYPAHTADLENGERDALPYYGELLWRYTQDAPTAKNDAERKFGKIANPTVHIGLNQLRKLVNALIQRYGKPAQIVVELARNLKAGLEEKERIKKQQTANLERNERIRQKLQDAGVPDNRENRLRMRLFEELGQGNGLGTPCIYSGRQISLQRLFSNDVQVDHILPFSKTLDDSFANKVLAQHDANRYKGNRGPFEAFGANRDGYAWDDIRARAAVLPRNKRNRFAETAMQDWLHNETDFLARQLTDTAYLSRVARQYLTAICSKDDVYVSPGRLTAMLRAKWGLNRVLDGVMEEQGRPAVKNRDDHRHHAIDAVVIGATDRAMLQQVATLAARAREQDAERLIGDMPTPWPNFLEDVRAAVARCVVSHKPDHGPEGGLHNDTAYGIVAGPFEDGRYRVRHRVSLFDLKPGDLSNVRCDAPLQAELEPIFEQDDARAREVALTALAERYRQRKVWLEELMSVLPIRPRGEDGKTLPDSAPYKAYKGDSNYCYELFINERGRWDGELISTFRANQAAYRRFRNDPARFRRYTAGGRPLLMRLCINDYIAVGTAAERTIFRVVKMSENKITLAEHFEGGTLKQRDADKDDPFKYLTKSPGALRDLGARRIFVDLIGRVLDPGIKGD

SEQ ID NO: 336 - protein, 1059 aa, Unknown
  Cas9 variant
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 337 - protein, 1269 aa, Unknown
  Cas9 variant
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKSEALNAKIDPKALSWILHDYLKNRGHFYEDNRDFNVYPTKELAKYFDKYGYYKGIIDSKEDNDNKLEEELTKYKFSNKHWLEEVKKVLSNQTGLPEKFKEEYESLFSYVRNYSEGPGSINSVSPYGIYHLDEKEGKVVQKYNNIWDKTIGKCNIFPDEYRAPKNSPIAMIFNEINELSTIRSYSIYLTGWFINQEFKKAYLNKLLDLLIKTNGEKPIDARQFKKLREETIAESIGKETLKDVENEEKLEKEDHKWKLKGLKLNTNGKIQYNDLSSLAKFVHKLKQHLKLDFLLEDQYATLDKINFLQSLFVYLGKHLRYSNRVDSANLKEFSDSNKLFERILQKQKDGLFKLFEQTDKDDEKILAQTHSLSTKAMLLAITRMTNLDNDEDNQKNNDKGWNFEAIKNFDQKFIDITKKNNNLSLKQNKRYLDDRFINDAILSPGVKRILREATKVFNAILKQFSEEYDVTKVVIELARELSEEKELENTKNYKKLIKKNGDKISEGLKALGISEDEIKDILKSPTKSYKFLLWLQQDHIDPYSLKEIAFDDIFTKTEKFEIDHIIPYSISFDDSSSNKLLVLAESNQAKSNQTPYEFISSGNAGIKWEDYEAYCRKFKDGDSSLLDSTQRSKKFAKMMKTDTSSKYDIGFLARNLNDTRYATIVFRDALEDYANNHLVEDKPMFKVVCINGSVTSFLRKNFDDSSYAKKDRDKNIHHAVDASIISIFSNETKTLFNQLTQFADYKLFKNTDGSWKKIDPKTGVVTEVTDENWKQIRVRNQVSEIAKVIEKYIQDSNIERKARYSRKIENKTNISLFNDTVYSAKKVGYEDQIKRKNLKTLDIHESAKENKNSKVKRQFVYRKLVNVSLLNNDKLADLFAEKEDILMYRANPWVINLAEQIFNEYTENKKIKSQNVFEKYMLDLTKEFPEKFSEFLVKSMLRNKTAIIYDDKKNIVHRIKRLKMLSSELKENKLSNVIIRSKNQSGTKLSYQDTINSLALMIMRSIDPTAKKQYIRVPLNTLNLHLGDHDFDLHNMDAYLKKPKFVKYLKANEIGDEYKPWRVLTSGTLLIHKKDKKLMYISSFQNLNDVIEIKNLIETEYKENDDSDSKKKKKANRFLMTLSTILNDYILLDAKDNFDILGLSKNRIDEILNSKLGLDKIVK

SEQ ID NO: 338 - protein, 1138 aa, Unknown
  Cas9 variant
MGGSEVGTVPVTWRLGVDVGERSIGLAAVSYEEDKPKEILAAVSWIHDGGVGDERSGASRLALRGMARRARRLRRFRRARLRDLDMLLSELGWTPLPDKNVSPVDAWLARKRLAEEYVVDETERRRLLGYAVSHMARHRGWRNPWTTIKDLKNLPQPSDSWERTRESLEARYSVSLEPGTVGQWAGYLLQRAPGIRLNPTQQSAGRRAELSNATAFETRLRQEDVLWELRCIADVQGLPEDVVSNVIDAVFCQKRPSVPAERIGRDPLDPSQLRASRACLEFQEYRIVAAVANLRIRDGSGSRPLSLEERNAVIEALLAQTERSLTWSDIALEILKLPNESDLTSVPEEDGPSSLAYSQFAPFDETSARIAEFIAKNRRKIPTFAQWWQEQDRTSRSDLVAALADNSIAGEEEQELLVHLPDAELEALEGLALPSGRVAYSRLTLSGLTRVMRDDGVDVHNARKTCFGVDDNWRPPLPALHEATGHPVVDRNLAILRKFLSSATMRWGPPQSIVVELARGASESRERQAEEEAARRAHRKANDRIRAELRASGLSDPSPADLVRARLLELYDCHCMYCGAPISWENSELDHIVPRTDGGSNRHENLAITCGACNKEKGRRPFASWAETSNRVQLRDVIDRVQKLKYSGNMYWTRDEFSRYKKSVVARLKRRTSDPEVIQSIESTGYAAVALRDRLLSYGEKNGVAQVAVFRGGVTAEARRWLDISIERLFSRVAIFAQSTSTKRLDRRHHAVDAVVLTTLTPGVAKTLADARSRRVSAEFWRRPSDVNRHSTEEPQSPAYRQWKESCSGLGDLLISTAARDSIAVAAPLRLRPTGALHEETLRAFSEHTVGAAWKGAELRRIVEPEVYAAFLALTDPGGRFLKVSPSEDVLPADENRHIVLSDRVLGPRDRVKLFPDDRGSIRVRGGAAYIASFHHARVFRWGSSHSPSFALLRVSLADLAVAGLLRDGVDVFTAELPPWTPAWRYASIALVKAVESGDAKQVGWLVPGDELDFGPEGVTTAAGDLSMFLKYFPERHWVVTGFEDDKRINLKPAFLSAEQAEVLRTERSDRPDTLTEAGEILAQFFPRCWRATVAKVLCHPGLTVIRRTALGQPRWRRGHLPYSWRPWSADPWSGGTP

SEQ ID NO: 339 - protein, 1265 aa, Unknown
  Cas9 variant
MHNKKNITIGFDLGIASIGWAIIDSTTSKILDWGTRTFEERKTANERRAFRSTRRNIRRKAYRNQRFINLILKYKDLFELKNISDIQRANKKDTENYEKIISFFTEIYKKCAAKHSNILEVKVKALDSKIEKLDLIWILHDYLENRGFFYDLEEENVADKYEGIEHPSILLYDFFKKNGFFKSNSSIPKDLGGYSFSNLQWVNEIKKLFEVQEINPEFSEKFLNLFTSVRDYAKGPGSEHSASEYGIFQKDEKGKVFKKYDNIWDKTIGKCSFFVEENRSPVNYPSYEIFNLLNQLINLSTDLKTTNKKIWQLSSNDRNELLDELLKVKEKAKIISISLKKNEIKKIILKDFGFEKSDIDDQDTIEGRKIIKEEPTTKLEVTKHLLATIYSHSSDSNWININNILEFLPYLDAICIILDREKSRGQDEVLKKLTEKNIFEVLKIDREKQLDFVKSIFSNTKFNFKKIGNFSLKAIREFLPKMFEQNKNSEYLKWKDEEIRRKWEEQKSKLGKTDKKTKYLNPRIFQDEIISPGTKNTFEQAVLVLNQIIKKYSKENIIDAIIIESPREKNDKKTIEEIKKRNKKGKGKTLEKLFQILNLENKGYKLSDLETKPAKLLDRLRFYHQQDGIDLYTLDKINIDQLINGSQKYEIEHIIPYSMSYDNSQANKILTEKAENLKKGKLIASEYIKRNGDEFYNKYYEKAKELFINKYKKNKKLDSYVDLDEDSAKNRFRFLTLQDYDEFQVEFLARNLNDTRYSTKLFYHALVEHFENNEFFTYIDENSSKHKVKISTIKGHVTKYFRAKPVQKNNGPNENLNNNKPEKIEKNRENNEHHAVDAAIVAIIGNKNPQIANLLTLADNKTDKKFLLHDENYKENIETGELVKIPKFEVDKLAKVEDLKKIIQEKYEEAKKHTAIKFSRKTRTILNGGLSDETLYGFKYDEKEDKYFKIIKKKLVTSKNEELKKYFENPFGKKADGKSEYTVLMAQSHLSEFNKLKEIFEKYNGFSNKTGNAFVEYMNDLALKEPTLKAEIESAKSVEKLLYYNFKPSDQFTYHDNINNKSFKRFYKNIRIIEYKSIPIKFKILSKHDGGKSFKDTLFSLYSLVYKVYENGKESYKSIPVTSQMRNFGIDEFDFLDENLYNKEKLDIYKSDFAKPIPVNCKPVFVLKKGSILKKKSLDIDDFKETKETEEGNYYFISTISKRFNRDTAYGLKPLKLSVVKPVAEPSTNPIFKEYIPIHLDELGNEYPVKIKEHTDDEKLMCTIK

The invention claimed is:

1. A method of deleting a segment of a target nucleic acid in a cell, the method comprising:
   contacting the cell with a first gRNA molecule, a second gRNA molecule, and at least one enzymatically active Cas9 (eaCas9) nickase molecule; and
   contacting the cell with a 3' to 5' exonuclease;
   wherein the first gRNA molecule and the Cas9 nickase molecule associate with a target nucleic acid and generate a first single strand break on a first strand of the target nucleic acid;
   wherein the second gRNA molecule and the Cas9 nickase molecule associate with the target nucleic acid and generate a second single strand break on a second strand of the target nucleic acid, wherein the first single strand break is located at least 25 base pairs away from the second single strand break, thereby forming a double strand break in the target nucleic acid having a first 3' overhang and a second 3' overhang,
   wherein the contacting the cell with the 3' to 5' exonuclease generates a deletion of the segment of the target nucleic acid that is at least 40 base pairs in length.

2. The method of claim 1, wherein the target nucleic acid is a promoter region of a gene, a coding region of a gene, a non-coding region of a gene, an intron of a gene, or an exon of a gene.

3. The method of claim 1, wherein the at least one eaCas9 nickase molecule comprises N-terminal RuvC-like domain cleavage activity but has no HNH-like domain cleavage activity.

4. The method of claim 1, wherein the at least one eaCas9 molecule comprises an amino acid mutation at an amino acid position corresponding to amino acid position N863 of *Streptococcus pyogenes* Cas9.

5. The method of claim 1, wherein the 3' to 5' exonuclease is a Trex2 molecule.

6. The method of claim 5, wherein the Trex2 molecule comprises an amino acid sequence that is at least 85% identical to the amino acid sequence of SEQ ID NO: 255.

7. The method of claim 5, wherein the Trex2 molecule comprises a nucleic acid sequence that is at least 85% identical to the nucleic acid sequence of SEQ ID NO: 256.

8. The method of claim 1, wherein the cell is a mammalian cell.

9. The method of claim 8, wherein the mammalian cell is a human cell.

10. The method of claim 1, wherein the cell is a population of cells, and wherein at least 20% of the cells in the population of cells comprise a deletion of the segment of the target nucleic acid.

11. The method of claim 1, wherein the segment of the target nucleic acid is located between the first single strand break or within 5 base pairs thereof, and the second single strand break or within 5 base pairs thereof.

12. The method of claim 1, wherein the segment of the target nucleic acid is at least 50, 75, 100, 150, 200, 250, 300, 400, or 500 base pairs in length.

13. The method of claim 1, wherein the segment of the target nucleic acid is 45-50 base pairs in length.

14. The method of claim 1, wherein the segment of the target nucleic acid is 47 base pairs in length.

15. The method of claim 1, wherein the frequency of deletion of the segment of the target nucleic acid increases by at least two-fold in the cell, relative to the frequency of deletion of the segment of the target nucleic acid in a cell not contacted with the 3' to 5' exonuclease.

16. The method of claim 1, wherein the frequency of deletion of the segment of the target nucleic acid increases by at least five-fold in the cell, relative to the frequency of deletion of the segment of the target nucleic acid in a cell not contacted with the 3' to 5' exonuclease.

17. The method of claim 1, wherein the frequency of deletion of the segment of the target nucleic acid increases by at least ten-fold in the cell, relative to the frequency of deletion of the segment of the target nucleic acid in a cell not contacted with the 3' to 5' exonuclease.

18. An isolated cell modified by the method of claim 1.

19. A pharmaceutical composition comprising the cell of claim 18.

20. A method of deleting a segment of a target nucleic acid in a cell, the method comprising:
generating, within the cell, a first single strand break on a first strand of the target nucleic acid and a second single strand break on a second strand of the target nucleic acid, wherein the first single strand break is located at least 25 base pairs away from the second single strand break, thereby forming a double strand break in the target nucleic acid having a first 3' overhang and a second 3' overhang; and
processing the first 3' overhang and the second 3' overhang using a 3' to 5' exonuclease molecule, thereby forming a processed double strand break;
wherein the processed double strand break is repaired by at least one DNA repair pathway, thereby deleting the segment of the target nucleic acid that is located between the first single strand break or within 5 base pairs thereof, and the second single strand break or within 5 base pairs thereof, and wherein the contacting the cell with the 3' to 5' exonuclease molecule generates a deletion of the segment of the target nucleic acid that is at least 40 base pairs in length.

21. The method of claim 20, wherein the step of generating the first single strand break and the second single strand break comprises contacting the cell with a first gRNA molecule, at least one enzymatically active Cas9 (eaCas9) nickase molecule, and a second gRNA molecule.

22. The method of claim 20, wherein at least a portion of the segment of the target nucleic acid corresponds to the first 3' overhang, or a fragment of the first 3' overhang, and/or wherein at least a portion of the segment of the target nucleic acid corresponds to the second 3' overhang, or a fragment of the second 3' overhang.

23. An isolated population of cells modified by the method of claim 20, wherein the population of cells comprises a distribution of lengths of the segment of the target nucleic acid
a) having a mean length and/or a median length within 5 base pairs of the number of base pairs between the first single strand break and the second single strand break; and
b) having a median absolute deviation that is lower than a corresponding median absolute deviation in the distribution of lengths of the segment of the target nucleic acid in a second isolated population of cells modified by contacting the second population of cells with the first gRNA molecule, the second gRNA molecule, and the at least one enzymatically active Cas9 (eaCas9) nickase molecule, without contacting the second population of cells with the 3' to 5' exonuclease.

24. The isolated population of cells of claim 23, wherein a difference between the mean length and the median length of the distribution of lengths of the segment of the target nucleic acid in the isolated population of cells is smaller than a corresponding difference between a mean length and a median length of a distribution of lengths observed in the second isolated population of cells.

25. The isolated population of cells of claim 23, wherein a difference between the mean length and the median length of the distribution of lengths of the segment of the target nucleic acid in the isolated population of cells is less than 5 base pairs.

\* \* \* \* \*